United States Patent 10,724,096 (METHODS AND COMPOSITIONS FOR INHIBITING AND TREATING NEUROLOGICAL CONDITIONS) - sequence listing, part 120

SEQ ID NO: 2214 - DNA, 736980 bp, Homo sapiens
ggggtagaagcggcagagaccgcatattccggaggggctggctccaggccacgcgagccggagctggagacatttccagagccttgaggatggcaccggccctcgcacgctcaactcctgctcctcctcttcgcaatgagtaaacgacgcagtaggtcctacccagcctattttgctttaccaaagggctttgctttcttagggatgctgtctttggatcttttttttccctgttgtgttgcgttggttttaagtgcctgctggtgtcgtcttccaggggatggggaaatagtttcttataagatgatcacttgggtttaatgttgaggacgacgctgttagtttgcagtaatgaccctacacctctaaggtattaaaaaaatgccttttatttaaattttgttaaaggggcagagttttccctctttttaaccacctgatactggctctaaaggttttcccctgagaactgtgtacagggcaggagtgaggggttggtgatagaggtgatgatttcgtgtgttggtagcactgacgtattcaatgttgaatgtattctatgatattttatgattatcctgttacatgttttcagtataatttagcattacttttcagagacgtaccagttggcaataaaaagccttttctgtatttaacactgtgaccgaatctgctggaaatttttctgtccaaataaatttcctgaaggcatacatcttaaaatctggagagtcaccattatttaaatactttgattttgaagctttgattttcttaccttttccccccttaaatgaaaagcttagctttaaattaccatgtgtatatactttgaattctgtaaaataaacataaagcaaatgaaacaacaactttttacctctcagatgaagttttcttctaggtaactacagaaataaaaactgactgcaacatacagaggggcccatgacaaaggggtttataacatacactggctttttcaagcaaatatttcactgtctgtaacctcagtttgtggaatgaaaggttttacgccttagtttttactctttgtggtcaaaaagtaaggcgtgcaatgggccatttaactgtagaagattaaaagttagtgtaatatctggaaagttgtatatattttttattcacaactcatgcaagtatctcaaaagtctttggacatttcattgtatttcctggcggggaaatacaatgtatgtgagttattttgttctccgagtagcttttctctgtgaaggaaatcctgttgcatttatataaagaagatagtttatgtcactgtctgtggacaccatatttgatatcttgaggtgtatagttctaagatttgaagccaatatgatggcactaagcctgaaattaggattttcttattttgtatagtgagctaattactaaaatacagtctttcatatgcctcaaacagctaacataaaacattaaaaaagccacttgcaacattctgtgattttaaaaatcatttcaattataacaatgtatgtacatagaaatgctcatttattaaaatgcaagacaatttatgtgtataatatatttttgtatgttttatgtattgtaagtcgtttagttcttttaagagagagagagacagagcaagcaagcaagaacttgaatgatcgaacctgcattttcattaagagaatcagttgctgccctaaggttgaggtagtatgtggtttaagattgggcaaagcactagctgtactgtgtgatatttcccaatgagattgaaacaattaatgggaccaaagacgattttaatgtgaggacagagaggtagttgtgctttaatttctgtaacttaagatcattctaagaacctttagttatctatgttttcatttatttaagattcatttttaattatattgtagacttgtattacatttctatctattacattcaaatttttcagatttcttcctgtgtgaatcattctgggaattctacaactcttaaactggccacctgtttagtttttgatttaaaattgttgaaggtagtatcctagatttagcaccgcctactggcttctcatggaaaaaatgtattttttcattcgccaagcgacccacagggatttagatcaatttaattgtgcagatcttttcaactgcttactaagcgagaaggagggaaaaaaaagtttctattttgtaatgagagagggtttccaaggtaaaggtggggactgagggaaataagacccacaaattaaattggcattggatcactatctgacctcaaacattgtactatctaaactgtgacaaagaaataatcacaaaatgaaaacctgttaaattttcaagaactttttatgggataataaaatgtgggtattgtttaaaatcttggattactaaattaatttttcaatgtctatctcagtcttgatataaagaaagaaagttctagttggaattctgtcttgagtgtgtggtctgttgaagaatatttaaatgaataacttttcatcattgaagattaacagttaattatttttcatatttattttttatggtcataatcaagtaacaccctgatttttttcttaacatgcatcaaatagccacaccgtggtggtgtatatacaagggggaaaagttccaaacataaaattataaagacacatccttagccataatagatgtgttacctttcttaaaaatgataattggtttattttctctaatttatatgaaagtctagtggttaaaagagctactataataatacaaataaatgatgccttaagaatatacaaattgttaattagaaaaataatttgatatgctaaaattttcttcctaattaaaagaaatgtgaaatatttggatagctgttccttaaatgcaatattgacttattttaagagccagtagtaagtatatagaaattccagtgagaagtataggtctgttgcgtttttgcaactctaccccagtaaaagtgtggtcatgttttgtttactgtttactgatagtgtaagcaactaattaagcagggcattcattgatataactctacatttcaagtcttcaaaaagctccattatggaagtagaagagaagtgaagtgggtatgtaagattgtttgaatagtaaggacgaatttgagaaaaatatttcaattacaattgatttttctctctgacttttgaaacttttatttttattttagttgtttatttttattttttctttccaacttttagtttcaaggggtacatgtacagttttgttacatggctaaattacatgtcacaggggtttgctgtacagatagttttatcggccatgaaatctttatttttaaatgatgattagctgagactttaaaaatagttatttctttacttcttttatcatactgtcattatgaaaactctgtgttttgctatgaaaacctgaagtaatgattaattttattcttcaaatttttatggacttccagaaagtaaataataacatgtttaaaaaggtccttattgatctgcagttattgttattattctcttattactgttactatctactacttccagtgacctgtacgaatgcttgtaaagatgccatttccataattcagtttgattctttgatttaataaatttctcttcagtaattggcaggcaacataaactttcattttattggcaataacaacagtttgttttgctaaatcatgattttgaaaacaatattcaataacatgtaagtaatatctgatttctgaatgtatcaatagcaagttacactgttaacaagtttacataattatacttgtcatcacccttccttttattattaaattttgatgtgcagactgcatagatataacacagctattgccaactttagtagttttgcttatcctcattgcttttagattttcaataatacattgggaattttgttttcttttgttagacttatgttaaatatcaaacttaccttgtggaaaattaactttgtgtttttctaaattcttccttacgtttaaaaagatttttgtttgctagttttgaattatcctgctatttttctgggactgagtcctggaaaatagaggcattggtttaatgtctttttctatccatttgtagccacagagatggcagttggaggacttgagttagtatttaggatttacattttctgggctgtccttgcagactcctcagctgggggtcaagactctaagagttatttatttgaccatgtaaaaatctaaatagagaggaaaattatggagtagaacgtggaagtcttgcactggtcttctgaaagatacaatagcatgcatcactaagtgctcttatattacaaaatactagagattttctgtgcataaatatgtttggcaaaattccatttaactcactaatatgctttttgcttgaattctttcccaaacttcagagtgggaattgattgcattcatacataatccatgtgtttagagaaaatgtttatacacattttgatagccatatgctaaataataagaggagcaacacatttctgagtcatttcggaaattattaacaggtgggagtaaggaacggctattttttcattaaatcaagatgagagggaaagaaattgatgtgtcaaatgaatgcaattccatttgtacttcccttccgtgattagataatagtattattttatatgttggaggaaactgagacttggagctcagagctccataggtggtaaagggaaatttgacatgtaggaagtcttaactgacgactcatgttttttttttttttcctacacagatatgcttcatttgtggagatgatttttttgtttcttttgtttttcctaatataaaacaactgttatgtatttattcttgatacattacttaagatgtctgtagtttggcaagttttcaacagggagtgctttccactagtgagtgctttgagcagaaacaaaagaatattgccccacacagatactcttaactggtcctgaaaggacctttctgtgaccatgtcatcacacatctcttcaagacgggttttctgaagagagccaatgcatggcatcacatttgtgagttaccactgttgctctgtggttgggtcagaagagacggttctctgtccttagttgctttgcagagagcctgggaaacacattcagcatttacttactgagtacaaaatgtaatctctactcttggagcttttgcagtgtgatgtggaaaattagtcttttgtgcaaggaaagctgaacagctaattctttcataacacagagctctgtaaatataggtgtcttgtctgtctaccaacatctcaccatcaacatcataacacctcacaattttactgttacacatatttgtatgtgacatttatcaagctcattttatgttagtaacataaaacacatataagtgtaacatattatttgaggattctgtgtttaattgcctcttcagatgtgcaagaatgtcttccatcattagtttccttggaacttgaaaaagtgaatactttcaatgcagaatgggaaacataaactatagtggaaacagtgtgaatgcacatgatgagatggatttttaaagacttggtcataagtcctcacgttcataaaatcagtggatttagaggtcaaagtatagggagggttaaatgctgcctttgaattttggaatctggatatcttgaaaacaggtggtataaaacaaaacaagagaaagtagtatctgtaggagagccttatttggttggaggtgggaaaatgattcaattttgaacatagtaatttgaagttctgacattaacttctggattaaatgaccaatgtgcaatggaaattcaggtctagagctgggaagcacacttaaggctagaaggagatatgacagtatcatctacattaaaactctttaagtgggaataagtcctgcacaggtagaaatttgggaacatctgcttttttttttgagtgaatgtaaaaggggctgataaagggcagaaaaatagagttaggatgatagccactgaagctcagaaaaagtatgtggggtgtgtgtgtgtgtatgtaagtattgttcaacagagctaatgctgcataggctcaaaagaagataagacctgagataaaagctttgtaatctgtcattaaaatccatgaatttttgaaataaactaaatgaatgtgattgatgatcctcaatatgatgtggcagcgtcataaagagggctgttgttcccaggattgtatgtgtcgtgtgtgtgtgtgattgtgtgtgtgtgtgtgtgtgtgtgtgtgtgtacagtgataacatgatctaaataggaagaccagtaggaagtttttcctgaaactagctaaattgatttgaaatttatatttatatgcaaaaatagcagagaatattctgagaaagaagagagggctaacctgttacataataaaatacactataaagctttaaaaataaatatatttactagctatgtctactgaaaaatcttcaaagcaatgtctttcaggaagcaatgagcccttctagtgcacaaagcatggcttcttaatatcattccccattcaagaggacaagagccctttagtcttccttaacctagaattggctgattctaagtctgggcagaaaaaacacaagatgagcctgggacaactcactgcagaaagtaaggaaatggtcaaagacaaataaggctgtatcattgtaaacaagtgctagcttgaagggccttccagttgtgcaatttaaatcagtttgaatttcaagagtgaatataacaaattgtaaacgttgagtaaagtaaaatccatgagtgcataatgatactctaaataaatatataaaaaagaaaaatgacaattaataattaaattgagataattaaatgattagcctgcctttcttagttgatgagggacagctttttacaaaataatgtgaattaagtgtaagaaatgtaagaattagaaaattactatttgtaactctcagtgaagtaagtgattcagtcaaagatgatcaacaagtgataaaataatcaattaaaattattttgatgaataacatattctcatagtgctcaagtattaattgcatctgcaagtcatcgttttaagtgactgaatgatttaacccaacatcaccaatagacaacctgacactatgagcctcctgacgagatgccatataaaggctatagtgccatttgtgaaatattgttgctagaatgtctaacctgaatctaataaaacctggttagatttaacttccagtttatagaaaaattcagagaaaggaccagttaaactaaaccatgaggaaataatgagacaaatgcataaggtgaggtattccacattgaagatacataccagccctgtggcctagacttgtaaaatgtcagtgccactgtgggaggacttttccagattaaaaaggactaaagacaaacaaatgcagtgcttgaagatttattttatttcactttttaaaaatgtggtctataaaaagtcaaattttggtagaattgggaaatttttcatatgggctagaaaacagatgatattagcagatgagtgctgaattatttgggataaatgcagtgatacatgaaactgaattttctttttttttttctttctttttttgagacaaagtcttgctctgttgcctaggctagagtgcagtgacacgatttcggctcactgcaacctccgcttaccatgttcaagcaattccccttcctcagcctcctgaatagctaagattacaggcgtgtgccaacatgcccagttattttttgtatatttagtagagacagagtttcaccatgttgaccaggctggtcttgagctcctgacctcgtgatctgcctgccttggcctcccaaactgctggaatcaccgtgcccagcccgcaactgaatttcttatgagtcatcaaaggagtgagggagggagtgtgtgtgtgtgtgtgtgtgggggggggggttgtgtacgtgtatatgtaaaataatcatttgttaaccaactttaaatcagggagtgcttatgctggttttattgtgttattctttctagtattccatctatttgaattttttttcgtaaggaaagttgaatagtctattagttgccattgagaaaaaaatatgtttattgaggctaaatagaagcagaagtccaattgcccatgtttaaggtcatctgggatcttgaagatatggagacaaaaaaaatgaagtttaatgttaaattgtgggaatgaaatattactcatcgaagtaatattattgaaggaaggatatttttaaagccacagtaaggaaaatatgaatgcatctttatgtttttcaggatggaatccccttgcaggaagaggtggaggtataatagaaaggaaaataatttttcagggtcaatttcagaatgttctaagaaggttggtgtgattagtagtagcgcaaggagatgctggttacgtctcagaagaggaagagaattgaatcagttcattagttaaactaagtaactcattatttatttaacagatatttcttgagcattttctttgtaagtactgtgctggaggatgaggattctgtggtaaataaaactgataacaatgctgactgcaaagagtttgccatttaatggtgacttcagtcttctcagataattgtaaatgaggtcctaggttgaaattaactggtatggagataggagctaggggagtgtagtagggaataagcatgaaatatagaaagattctagagctgtaatgaggaacttggcaaaattagcatttgttgtcactttagtcaacacagttacatcacttctctaggaacacttagcctgtaatctgaatgggttaaggaaacagttgaggattacttggttagagactagaaaggcatccactttgtgtaaaacaaagtgaggagctttccagaggtagtggatatgaagatataaataaatctgggctgagaaagagagcaagggcagctctacgagatgaacagaataagaactggtaagatttgaaagcctgaagagcaggatgaaaatgaatagcagactcactaattttaatagaatgagagtagtgcaaggatggataggtttggtcagaaaagactattgtatttctagcgtttgacagtggaacatcgtcaaatggtgaataaattttagagtatggtaaagcatgtggctaagaaaggaagacactgctgattttgagaagttaagatattgtgaggtgaagctgagtattaaaagtgtaattttgaaaacgtgatttaaaaaacctgtaacaggatgacaagtgaggaggtggaaaggaaaactataaatgtatcaaaagtatcagtgatatttttagagctttacaatcaactaagaccaaaacagatttttttttttcatttgtgacttctaggactttagtcctttctttggaacattttgaaggaagctatagatatgtaatgtgtttgtgtatcttgcttacatttgaaaagaattttcagttactacagaaataaattctgcagtggatacagcaatgcaaccctttgtaaggaagtctcttttcaaaaccaaggaaatgaatataggatcctataattaagtataacagtgaatgattcagattgaaaagaaagctatggagtatttgttaatacatttttattaacatcagaagtccagatagcaggtatatagctatatttactgctagttctgttgctgctgctctgttgagatctcattctatttatgaatcaacattctggaccagactgactgagaaatgcttagtcagatagagcctcatctttgcaacactaggagagtatattaccatagataataatatttaggagaaaagagaggatcagacagttgacttgttaaatgtcttcttgctattaaatggctgagtaaagatctgaacccaggagtttttggcttcacaacttgaatgtggactactgtattttgttcaacagatggaaaaaaggagatactttgattggtacagcaataggtcagcaacatttgtccaataaaatagacacgctcacataattaatgccctcacaatagctccctctgcacagcatgttaaaaacacacaatgcttacatttagaactgtagtgcaattgattctgattctagcccctcttttcagagtcttccataatgtctcttctgtgggcataatgggtgagaatttcaacaattgtttgtatatttagacaatatttgtcggggatctattatatgtaagtcactgtatttgggtcaacatggtgtgaaaccccatccatctctactaaaaatacaaaaattagctgggtgtggtggcatgcgcctgtagtcccagctactcaggaggctaaggaaggagaattgtttgaacctgggaggcagaggttgcagtgagccaagatcgcaccattgcactccagcccagcgacagagcgagactccatctcaaaaaaataaaaacataagtttttaaaaatcagaaaacattggtcttaccctcctgaatagacagttttcaggaaaaggaaatgctttatgtgaaaagtgacaatgcataaagttatgactattaagaaaagtaaagatgattgcttgtagttctttgggttattaaggcacttgaacaaactagcatgcaatttctttctcccctttctagtgacttggtgagtcctcaggttgggagattatgtattactctcgttccattgtattccaaagccaggaatgtatgacagtgtagagaagaggtgtgtagacaaaaaagtaaagggggccaagtgagaggaacaacagcaacaaaaagatttagagcaaattgtctggaaaaaaaactggaagatgaaagtaaatggtgaaattttgaggaaaataggagagagtcagggtagaggtacaattaacatgagtttgcacctttgtatttatccttattttatgctttaatatgaagtctattgttcaggagagtgaagtttatcctggaatatattgagattactcaaaacttcaaataaacttattagaaactgttaagtactataaaatatataaaatgaatttagaaaatatctatgcttttagattttttacaatggctctaatgatatagctttattgataatttaaagtagattagtgaaccaatagtatgaaaatattttgttttattctgaacccatttcatcatgtatgcaatctttttatttcataattgctggatctttttccctgttctagtcctcccactggacagtggtacaacttaaaagaaaaagggaagcgtggaagaggggagaaaggaaatggaagagaaagaaggaggtcaacaatagccatgaacaagctttctctagatcactgttcaaaagaaacgatgcaagtcatgcaagccagccacatatgtaactgtaaattttctaaaagacatattaaaaaagttaaaaagtgaaacagctgaaattaattttcataaagattttatgtagctcagtgtatcaaaaattattttaacatgtaaccaatataaaattacttttaaaatattctgttttttgtgctaagtctttgatatctagtttgtattgtatacttaacagcacagaacagccacatttcaggagctcacaggccagtggctatcacatagaacagtgcaaatatagagtgttcatagaggcttcagggctatgtcatgttttcaaactccttttggcatttgttccttatcggagattatccaagatagattttttaaatactctctgatcatttcaatttcagctttcactttttattaaatcctaaatagaaatccattgaagttcatatttgccaaaaagttatcccaaaatatggtcccattgactaagaaatattaaatttatcttgatacttattgttcttcaggagcaagatggccacttttactaaatttgctctttcagtctactcatttgttatttggccctggaggtaaggaaataatgcaattgtcagaaattggtaacatcttcataggataggcttctatattagtggtatttgcctaacacctaatttaatgagaactatccatggccttgcagagaatcactcattattttaaaaacagaatgatatacttaacatgtaaatttgctaacagatttaacaccaattgaataccaacttagtttcagaagttatttgaaaacataatagaaaatcctgtatctagttatctgtttcctgcattttcgaagtccataaatgtggaaaatcaagaggcttatatactgtgaaaccccgcaatctacacagcctcattttcttccccacattcttttcttcttatcagaccagtttcttctgagtctcacatgttttctaatatggagttaaagacatgtttacccatttttaggtcctgactttcatacaaagaagataatcctacaacttctaaccttccatttttacatcctatttacatttttgagatgaatggtgataataaagatattaacaaccaccaaaacaaccaacacttatttagtatttagcatgtatcaggtgttgtcctccaaaccattgctttatttttctacttccccttgatctccatccattgagctccagaagatgagactatctaagtatgaaacttattttggggccgggcgcggtggctcacgcctgtaatccgagctctcagggaggcaagaggcgggaggatagcttgagcccaggagttcgagactgcctgggcaatatagcgagaccccattctccagaaaaaggaaaaaaaaaaaaagacaaaaaaaataagcgaaacttattttggattatttatcaatacctgaaattttatttcactcttttttgtttgtttgttttcttgtttgatgccttcttctcccattaggcgatagctttatgacaatacagtttatcttaatgatgatttccagtacctagacagtacctggcacacaggaagcactcaataaacctttttgaattaattaattagtgaagtagttcctcactgatgttttactgcacttgaactcttttctagatattttcaatatctatgtacacactctttagtaggatgtaggtagaaactgaaaagaaaagatttttgaggaactttcactacaattcatgacaattatctctaaaaatgtgaaaaggaaaacataatttctccagcatgaaggagaaaggacgtaactgctaagagcatatgtgtactgaaatgataatttgtcttaacagttattctacatttgtagagggctttatcattcaaacatattcatatacattttaattttattctcactgcttcatttctgaatgttgaaatttatttgtatttatttattaattttttattttgtgggtacatgataggtgtatctatttatgaggtccatgagatgttttgatacaggccggcaatgcataacaatcacatcatggaaaatgtgatatccatcccctcaagcatttaccctttgtgttacaaacaatccaatgataccctttggcattatttaaacatgtgcaattaaattattattgattatagtcaccttgttgtgctatcaaatactaggtcttattcagtcattccattttttgtacctattaatcatccccacctccctgccacccttcccagcctttagtaatcatgcttccactccctatctccatgagtttggggacgtttggatccccagaataagtaagaatatgcaacattgatctttctgtgcctatcttacttcgtttaacataatggcctccagttccatccatgttgttgcaaatgacaggaactcattcttttctgtgtctgaatagtactccattgtgaagtagatagtatgttttctttatccatttatctgttgatggacactttggttgcttccaaatcttggctgttgtgaacagtgctgcaacataggagtgcagctatctctttgatatactaatcttctttcttttgggtatatactccagagtgggatttcgggattatgtggtagctttgtttttagtttttttgaggaacctccaaaccgttttccatagtggttgtactaatttacattcccaccaacagtatacaagggttcccttttctccatatcctcgccaacatttgttattgcctggcttttggatgtaagtcattttacctgggatgagatgatatctcattgtcttttcgatgtgcatttctctgtgcattactctgatgatcggtgatgatcggtgaccttttcatatgcctgttttcttcttttgagaaatgtctattcaaatattttgtccattttaaaaatcagattattagattccttcctatagagttgtttgagctccttataaattctggttattaatcttttgtcagatgggcaatttgcaattttcttccaatctatgagttgtctcctcactttgttgattgtttcctttgctatgcagaagctttttaacttgatgtgatcccatttgtccatttttgctttaatttgttatgctcgtaggatattactcaataattttttgcccagaccaatgtcctggagagtttccccaatactttgttgtagtagtttcatagtttgaggtcttagatttaagcctgtaatccatattcatttgatttttgtatatggcatgagatggttgtctagtttcattcttctgcatatgggtatccagttttcccagcaccatttattaaagaaactgtcttttccccaatgcatgttcttggcacctttgtcgaaaatgcgttcactctaggtgtgtgaatttatttctgagttctctatgctgttccaaatgttgaaatttaatctcagaggtgaagtgactcagtctgcttacctagtaaatgtcatggaaagaacttatctctgccaattgcattggaaggtaatagtgtagcctgggagttctgtagatcctctaatttaattttagtcagctatttggaatagtttgaaaatcccagtacttattatgtaattttgggtgcttcttattacatttatgataagcaattcaaaatattatatattcttatgattcaacctgaaaccaaagttttctgcttttactcgtttgagcttctgtaacagtattagtgtagcatgagattctaatggttatcatgaacagttaaactgttaccatttacaaatacttaattatattgataagaattttcgaaatacagtacactaaacaaaataaatacattggatgctgagactgatataggatagcagtgatgatcagtggactccagatacaaagctttgtgttcatcaaagcaaacgtcatttcaggtattgattaactttaaaatagagtttcacaaatgtaaattaaaaagtaattttaagatagaagttactacttatatctaatttaggatattttatatagattttcattaaaaggaagtgtcctaagactaaatacattttaaaatcatttccttcatgcagtttttgctaagaattttaactatttgcaaataagagtatcttaaaataattttaactgttaactaaaccacaacagttttgacatttgttgcttgaaaagtgtagatacttttctatctatattaattaaagcttgaacaaataggattaatatttatttaaaagatgatcttggtgatgtattttaacagtttcttgggctattttgcaaatagtttgtgagtgtaaaattaaaaggcttgaaaatgcattcctacttttaatggggggatgggatgacaattgtgtttttaaggttgaataatcactggtttatggcacttaactcttttactagttcacaaactatgagtatattgtttacattaatttaagcaatgcattatgttcacattatttcatgaatgttttagtgtagttatccaacaaatatttcatgaaaattcatttttttatccttctgtgtgtcacaaggcattatataatgtataagaatggagcttacagtgcagaaggagctgatggtgataaatttcacaagtaaaaataaagttcagggttaagatagtatcttattctctattaaatcagaggattaaccttcctatgcatttccagctacaaaatgtgacccatgatgaggtgagtgaagtcaaatcagcttttcaagactatatgtaaaataacatgaatagaaagaaatacttcaaatttatagaatgttaatctgtatagtctttgaggttaaattgatttagtatctttgactaaaacttatgaatcagtgagaatttgatggggaaatatgagcatgtaatttcgatccatcatctatctttatttgttggtttagagctaagcatatgtcagtattcccagtataggtctttcaaggtatgtctctgtatgtaagggtaatataaccttgtgagtatgagtatgagtgtgagtgtgtgtggagaaatcaattgcttattaatagctttaggaaatggtattagttatttagttgcctaattgggggagtagttttcattcattttgcttttcttttttttttttcaagacagagtctcactgtcatccagtctggagtgcagtgtggcatgatcatggctcattgtaatcttgaactcctgagcataagggatcctcttgctttagcctctctagtagctggggctgcaggtgtgtgccaccatgaccagctgattttttatcttattttttgtagagacagagtttcactatgttgctcaggttagtctcgaactcctgacctcaagcgattctcccacctcagcctcccaaagcactggtataaaaagtgtgaaccactgttcgcagctagcatatttatttgatactatgtctctttgtccctaaaagataaatgatatgtattacatttaagtaaattatattatgtcatagatttcctttttttatatccaaccctcacaacaggtgttaggattttaatggttatacagcattccattgtaataatgtactttgtcatgccccattgtgaatattttagttggttcttttttcactttcttttcattgctattttgaataatgagtatttccatacactttttgtggttattttactgtaatattgcagttttgtatgcacttttattttatatgaatttatagacttaatttatatttttggtttaaaaaaaaaaaataaagcctagctcttcacctagtcttcatctaaaggactttaccttcttacctaacactggtagagaaactggctgggttagatttacttaaagatgatataaaacatataaaatcatgtataagtattatatgatctattgaagggattttttttttttttttttttttttgagacaagtcttgctctgtcgcctaggctggagtgtagcggtgcaatcttggctcactgcaacctccgcctcccgggttcaagcaattctctgcctcagcctcccgagtggctgggattacaggtgcccaccaccacgcccagctaatttttttgtatttttagtagagacggggtttcactatcttggccaggctggtcttgaattcctgactttgtgatccacccaccttggcctcccaaagtgctgggattacaggcgtgagccaccgtgcccagccctgaagggatttttagaagtaatttttatgtatctttcatggtgactttagactctaaccactaggaattatgctacaaaattgcattttgtacagtattttcctggtgtaggcatgacattttgaacatttactttaaaaacttgctaaatgtattttttcattaaatttaaaatactataatgatttcttaatattttcagtacgtacatgtatattagcttttgagtacaaatagtaacacatttttagtaatttatcattcataggtgaaaattgcttgaaacccataacataaaaacagaattacacaggaacggagtagagagatcagtccctcatgtagttgtaaattatttctagccacacaacaaaagaatgttagttattcgcaaaggaaaaagaatggaaatgagaactgtgcttatgacattatcactcaagtggtttgggtttcttacttaccataaggagagtgtttgataatgtggagcctttctagggaaaaggagatgtaaagtacattctccttttgagtcctgcagagttgccaggatgactagtttgttgaaaagaaccatttggtgtccttccttcttttctttctttcttttttttttttcttctcacttgagtgaatcactatagaattctggaaagtacaggaagaaaatgataaattttcccagcagatttttctaaactaatcttaatggaacttttcaagtgcttttatttaatttacccatgtgttaagtggggtgttctcccatcatgttgttcatagtgatagtaaaaagtggtgctgcttaaaatatattctgtagcctgttggtttctgttctgaaacaagaattgagatttccacaacaattttacagaataatttcatgtttcattatatgtctttgtgttttctccctcacttttctagtaatatattttcattgtattctgtaaaatactggtttgtggttgattggaaatggaaaatgagcttctcaagtgcaatatagatagcttgagaagttcaggtacagaacacacactgcatttacacagttttagtttttcctagattatatgcttcttaaagataggtattgtgaaattcagtcatttatttattctcatattctggcattcattcaataatgctattgacatagtgttagtcactgatgccctggatgaaaaaaacatcatcccattctcaatggactcaaaatatccagagagtatctcactatgatactctcttatagtgcttatagattaagtaaacattcctggaattgaatgtacttctttaaatgtatgtgtgtgtgtgtatgtgtaatgtatatcatatatactcagtgtataagtttttttgttttttaagcccgtggcattctgtgtaaattgcctaaatttcaaagttaatcatcacatataaataatactgaattattcctatagtttaagaattctgaataagaacacagaaatatcatgtagagattgatagtctcagtagtttacccaaaagatctgaataaatattggaatgatcttttaacaggttgactctagctcagaaaaaaaaaatgagaggaagagcaccacaaaaatatatctttttatcattggattaaaatatctagaaaaacactgataaataaaatctataaataatattctgccgttgtcttaaaatttaaaaaatggggaataaggtattttttctttcttacaaagactacacatattttgacccaatctgtttcatgttgaatggaaacaaacttgcatcataactgtgcatgtcattactgcctgctggttctaccagtatgcttttgcatattcttgatgaacaacaatattacctaaatcaagtcaccctgctttgtgttcatctgtttggtttttcttgttgttgtttctacaaaaatgttgtctcaccatactatgttccccaaagtactgctgtgatactttgctcctttctaatatttggtgaattcctaaatgtatctactttgtgcatgccatatgttcaactgctgtctccaatttcattataaagcttatgtatttatataatcattccaaaaataattcactctgaagacataatttcagtaagcagagagtgttcagcattactaagttaaataatatataacacttatttgaattcttactgtgggctaggcatacaaagtatgtgtattttttctcaaacagtcctcagagctttattgtttttattcctattttatagatgataaactggaggctcactgggcctatgcttcttgcccaggatgacagggctagtaactagcagagctaaaacttaagcccaggtctgattctgaaatcttctaactctgacccactagattattctcatctcattttatatgctaggttaactaggatttgattatttacaaatatggccctttcgttttatatacattgttatattttctgcctaataaaacatatgttgttacttccaaatatcttcaaaacccatggccacaggtactgttctcgatatgcaattactgaatatttacaaatgtggctccagtcagctaaagagaaaaatgtaatgatttccagggtccacccctctaatagctgttgtctttagtttttcaaggtcaaataaatgaatcgtgatgaggaaggccacgtgtctagaaaccaactgcatgaaacccttttctgttcaggatttaagcagtgatctatttaagtttgaattagacaggattccaaaaggtattataacctgaaaatattacacagcccccctctaacacatataccacatatgcaaagggaaagccactgtagctattttactcggaagttttatcttttcaatattctttgacttctaatgcaagtatgttacttgaaggaataaatatagtgtatatttgggtctgaatattagcactagttatcaataaagagcacaagtgggaaatccatgatgtcaagtaatctatctttgtaaatctaccttaacaacctagtctgagaaggtgataaaagtagcatcataaattcccatcagtttagcaaataaatgctgaacattgtgttagtttactagggcttccataacaaagtagcagagactgggtggtttaaacagcagaaccttaactttctcatagttctggaggctggatggccaagatcaaggtgttgccaggtttgattcttctgaggcctgtctccttggcttgcagatggccacatttttgttgtgtcctcacttggcctttcctgtgggtgcatgcctccctgttttctcaatctcctcttcttaacatatgtgtacaccagtcttattggattaaggcccacccataagacctcattttacttttattacctctttaaaggccctttctccaaatgcagacatattctggagtactgagggttaggacttcaacacatgacctttgtaggggatacaattcagttcataacatgtatgaattattcttctaagcactgtgggaaatactaagagtatagatcacagttctggttttcaagtagtttaccattctatgtgggaccaagtaaaatagccacagcttgagtgcatgggtgatctggaggtaacttcagccttcctcgtggtacctaaagtcaggtgacctcatttgagtagctgggaaagtgttctttgctcagtcactcaaaagctccttattttaagagggaacttttcttattagaaaatgtaattatttcatcaaggctatatacacgagacactgaaaaaacagtttagtgagagcatatgattaaggactgaattagtgctaaaagtaaattcaattagaggacaatatgaattccgtttttcaagtgagaggtatgaggtgtctctagaaacagtaattgatgatgcactttgaggaatagttaggaatgaagagaaagattttagaactatctgagtggaggtgatatgtgatagttgaaatgaaaatggatttctctgggaataaggaattgtgggcagcaaagagattgtggcgcgacatttaatcatgaggcatgctgaacatgagtgagtcaaaggaaggcacaccagtgaggaagttgaaagttgtgtagctttatgaaaactgaggcagagattatcatgcaccaaagccccatccttgaatagacatttctcaaaagaagaaatgcaaatggccaaaggtatatgaaaaatgctcaatgttacataatcatcaggaaatgcagatcaaaaccacaatgagatatcacctcacctattaagataactatagcaaaaagaccaaaaagataagtgctggccagagtgtggagaaaagggaactcttgtgtgcttttagtgagaatgtagattagtacagccattatagaaaacagtatggagattacccaaaaaattaaaaatagaactttcatatgatccaacaatcccactttgggaattcaaaggaaattaaaccagtatctcaaagagatatctgtacttccacattcattgcagcattatttacaatagccaaaatatggaaacaacctaagtgtccatcaatggatgaataaagaaaatgttatatatataacattatatatatgaagtatgttatatattatgctgtatataatatacattgttatatatcaatgaaatattattcagccttagaaaaagaaggaaatcttggcatgtgagacaccatggatgaacctggagggcattatgctgtgtgaaagtaaccaagcacagagacacaaatactacattatattacttatatgtataatctaaaaaagtcaaagctggaagcagagagtagaatcatggttgcttgggaatgggaatggacaaaatggggagatgttggtcaaaggtacagtgtttcagttatgatgggtgaataagtttggaagatctaatatactcagcacagtgattatagttaataatactgtatcagatacttgaaatttgctaagacagcaggtcttaaatatattcaccaacccccaccccccaggaaactgtgtgaggtaatgggtattttaattaccttgactgtgataatcatttcataatgtgtgtgtgtgtgtgtgtgtgtatatatatatatatatatagaaacattgcattgtacactatacatgtatacaatttttatgtgtcatacctcgattagggaaaaaaagtttcatcaaagggaaattagggaaaaaagtttcatcaaagtagaaattgcagttcgctctttgaagaagttagaaatgcatttaacttgttagggggttattaggagggaagatctttagctgcagagttctattagcaatagtaaagaacggatcaaagccaccgtttttctgtcaaaaatttgagttttcttcatgggctgtttggtacacatatcggattatgatactctataagtaacacaagattgatcggctatatgaagctcttttctgtagagtattaaattgtgaaatcagtaataaaagtctgtgtgttaaaaatcgttagcacagaaacaaaaattttagtgtttgaaattttttaatttcattgacaaactaccatttttctctttaaatccgatttttctttgtgtctaagtatatcggatgtactggcagattagaaacattatcatgagtaatccttctcccctcaaaatatgattggtaccttttttagacctactctcagcttcactgtgtctggtaatttttttttaactaatcagtaaatagccctactgttaggtctgtgatggttcttaatgccctcggaaggagcgtaagctttctgggagggttttaagcttctcaagaatagagaaacttggaagggcctgggagctggcaggcaggtgacctgcctataattcctgccctgccttttgagctcatcccacacttttcttgcttgagcctcagtttcctcatctatatatcatctatagaaatgatgccaaattttttaccctaattaataaaatgattgacagaaccacttaggctagtgttactcaaatgcattattataattacttcctatttaaaatgtttaagtttaaaaatttgggaagttttaaatcaggggtcacaaacaaagcggaaactttccttttgtgatataagagacttctttaactcaggtacctgggagtagcagctctgtctaggaagccagggtaaaatagatgaataaggaaggagacattttagctggaagactgtattggctgcatgaggctctcatccctttgggagttaggcgaaggctgtactttagttttaaattggagaggctttgtatatgtacacatgcatacacacatttaataataataaaaacatttaaaaagatttaacaaatattgcataaacatcccactcctccaccaaaaaaaaaaaaaaaaaaagaaaagaaaagaaaaactatgcatgcgagatattacaagaagcctatttttaggaggtattgtcttgctgatattccctgatgtccaacagatgcatgtgcaattttcaaagcattgctgccggttgaacaaaacataagtgctggttttttgtaacctccctttctgtggccactttgtggccccggttatgaaagctttttagttttactttgatgtgccgtaaaaaacacaaatttagaatcagacatatctagactcagatactagctttgcatcctacactctaaaagcttccttttgttggaaagaaaatggggatgggaacatctaactctaattgttattgtgagtgtcaccttttataaactgagccactacagggcaatattttcaataaatgatggcttcttttttgtaactcagtggcccttatgccaaatttagaattacctgggagttttaaaaaattttagtactctgattgaagaccctagacttaggttcacctgagcctaggatggagctggaaatctatgtgttagaagtccctcagtttgttttacagtgctatcaggtgggaaccagtgctgtaataccatcagataaatgaaaaacatgacaaagtagatttggcattcaagtatagtgttctaacacctcttcatccccaactacatgtgtatgtgtacatgtgtgggtgtgttccaatacaatgactatttctgaataggtagctatcattatttgctcaggatactgcttctatgtatttttcatttcgtatttactcctctttggctgacaacctatgtagtgtgattatgaattaatgtagctacttttctcatatggaaaactcacacaaaggcaaaagtagttattaaagaggactagtgacagcatcactggaattaaatgtgtgcctctgaagctgattgctttggattgacagtacacagctcaaggtagatattctgatgtttttgaaatgcaccctacttctttatatgctgtctagtcttgtggcttcagaattacacaagcttaataataaatatgcatatatatatgtgtgtatgtgtatatatatatgtatattcttaattacttttcaaattatttaaattaattttaccgagcctctgtattgacagctgataaatctttaaatcctgtatttaatattttaataaataatgtttaatacattatagatttctcaaattggattttttttttctaagcaactccttatatcaccacaggaccagtagtgctagtaccagcacgagttgcttctcacttaattagtgggtcattcataaaaacaatacttcattggcttaaaaaaaaagctattgtgatgtaataaatatgtacaggcgcttattcaagagtcaaaatagaaataaagtataaatcgcctgctcttctggatcattccctctaccagtgcggaaaattcaggaatgttcataatatacagtgttttattttatacattggcacaatccatgctgtaaggtcacgagccacggaaagcttattgtatagtttgctgaacattttttattatattttattttcaccaacttaatttttcagcaaggctctatgccattcatgcttgtacaagaggcaaatacacatggattattcatttcactctgtttccataaattgcatcatttagcatcagtgtcatgtcatagctagctctgtgtacctagtgtgtgctctcggcattgatgtatgaatgactagcataatctccctattgcttatataattatagtgaataataatgcagttttctataatgtttaaatattggctagtttcttaatacttttttattattttatgatcaccaataaaaaacatcgccaattcctgaataccaactgtgtgcagatattgtgtggtcactgtctttatataatccctgaaagatcagtgtgatccccattttacagatggaactgaaaaattaggtcacttgctcatatctgtcatcaagtggcagagcagagatttgaaaatatatatctctgactgtacctgacctctttcttgcatacctttctcgtacatcatcataactcctaccacaagattgctgttacttaaagatcataagaattagagttcctgaagccccttagttaatactttaacaactggtcttcatttgaaatgcacaactactagctttccactcgcagcttggactggggcctagaatggtctattgaatgtttggttgtttaaatgactgcagcaacttgcccatcttctccatcaagctactgaatagtaatgtaattagatccagcacttagattttgcttcctcccataatattttttatcatttggtgattagattacaatgtcaatgattagcatgtagtttccccaatctaagcagtaagaagctctctgttctatgtttgaaaatggctgtaaggttaatccactaactgcatgtaccttgatccaaaattatatactgatgaatggtgatgaattccatgaaattcaggaaactgccttgttggctgacagcaagatgtgttatgattttatatagctgtgtataaatgtttgcagtcaatcagaaccatgggaaaacagatttagaattatagaaaatacatgaacctggaaaattaaccctagggaaaaatctgtggagacataataataatagtaataataataaaacattatcaaaaatttatttggtacttgtatactgccaagcaatattataagcacattgcacgaattgtatcgcctttaatagttacaataaccaaggaagaaattgaggcataaggaaggtaagtccaaggtcacagaacagaaaattcactattgcaactcaggcagttttagttcaaattttgtgttcttaacaattgtgaattctgcctcttagctcttctgagtataaaatggatgaaaatgcagttgagtataagatgcagatttaatttacataaagtttcatagcagaggttaataattctgaatatacattttgtgtaaaacatattttctatgaattacatcactgtagtgttttttgacaaataaatggaaattccatttattttacactgtatatttttaacataaaagtggtattctagctttctcccttaccataaattatattatcatttatttacctacgtttgtattttcaaaatcatgcttaatagttgataccgtcctcatgacgccttcattttttttctggggagatatgattttctcagtgtttattttaaaaaattattcatagagacatgtaataagtaacatgaaatcaccagcaagtgtatcccaggcttaaaatgagaacacacattgatctctgaagacacaaagcacaaaggttattgcttcatctaaattttgatgaaataatttcagaattcaggaaacaagacttgataggaatatctggagctgtaggtgaagtacaggcagtataagtgaggtaaagcaaatgtgagcaatgtataaatagaaatctttccattgaaaaacaagactgataatttcaatatttccctaaaaatatgctctatgagtttatgaatatatacttgaaaaagatcagtattctcttaggcatgcttttcttcaattacctttgcatgtctgaaacaagctgttttattggcagtttttatcttaaaaaaatttttaagaagatttagataaataacagaaatgacagttcagtcataaataagtaatacaataaaaagttatctccttacataaatgtaccaaacaaatgagattttttgaatcattagaaattattctttataacatgcctaatgaattatcattgttctctttttttacattctggaaaattctcagagtatatagatacaatagataactgtcttacttactgtatgaaaatagaaattttcagctgggcatggtggctcatgcctgtaatcccagcactttgggaggccgaggcgggcgggtcacctgaggtcaggagttcgagaccagcctgaccaacgtggtgaaaccccatctgtactaaaagtacaaaaattagctaggcatggtggcaactgcctgtagtcccagctactcgggaggctgaggcaggagaattgcttgaacccgggagacagaggttgcagtgagccgagatccctcaacgccattgcactccagcctgggcaacagagcaagactccatctcaacaacaacaaataaatgaataaatttttaaaaagcaaaaaagaaagtagagaatagaaattttctgcaaatagtaaaagtttgttttatgtttaattattttgaaaacatgcatcacattttatttttaaaattcttatcttttaaaatatattgtatttggaatagattagcttttcttctcaaaaggaaattgtgtgtgtgtatatatgtgtctctttttggttcaagatgaaagtaatcacaacactaacacaaaatacatgctacagaatatgtgttacataaatcccactttgaaaacaaatccctgaaatgaatttcatgtatttccattaattacagagaagtattacaatgacatatttatatttcggttctgtcctaagaatatatgttcgaatgctcaattgacatacatacatattggaagttatgtatgcaataacgatcaatctatgtattgtgaattccctcaatgtgccttattactataagagtgacatttcaatgatacattttattgaactttttcattgatattattggaatttgaatgaagaaaatgtgaacagagtttaaggattattaaagttcctctaattttatttctaaagtattagcacattatttggttttatctttagctaattttctctgctatggctgtggttcattattgttatcaattgccacaacctgtatctagtactttaggccaattatttatagaatatacttaattaggtcaaattaccttaggttgttaggttgttaccttgggtggaaaagataagacaaggtaattaggcagcttgtaagtgaactctgagtaatgaaaattgataagttgcatataaggaattggtatcatttcatatacatataataagaaatagaattgtggattttcttatggtcaaactatttctgataattagatggatttatatagcctgggatggaatgagtctgtgatttatcaaatgagtctttatgctttatcaaatttaaataaactaagtagagaatatataatatttgcatatatattcatatttggcataaataaaattacatatttactaaaaattctatttacctaaatacttctaaaatgtgcaataatgacttattttgcccttttagttatatgttaaatttttcaaatactgtgagaggcaatttaatatcatttactgtaatatccttgataacattaatatacctaactggcaagagttagttgagacatttttactgaattgtatattaaccctcttcagtgctactcgaagtgtagtctattcactatatcactgtcatgttaccagtgtctgttacagatttgttgggagacagaaaataggaattagcatttaagaccatttatgccaaacaacagagtaatttttacctattgcgtttaataaatattttggatttttttgtgtgttacattttgtatcatttttctagtaattaacttttattttttttttaatttttatatatttatttaatttttgagacggagtctcactctgtcacccaggctggagttcagtggcatgatctccgctcactgcaagctccacctcctgggttcatgccattctcctgcctcagcctcccgagtacctgggactacaggcacccgccactgtgcccggctaattttttgtatttttagtagagatggggttttgaggggaaaggagaagcctggtccttcctcagagttttacaagaaaaaacactgatttatctgattcatgattcaaaaagttcaatactacaaccaaaatatagtacacattttaatatcatcattgtaacaggaaaaaactgtcatatttgagtaaatgtcatagccataatgatttttgacatataaaatgcaaaaattggcattatgattcaaatatggaaacattttattgaaatggccatcagcactaaaatgtgttctttctgtttataaagaaaatattttataccttaccatttattgattctgaataatgtaaaaattcttatatttaaaagtttattcatttaaaagcaatgtattatgcattatatttatatatggatataaatgcatatctattcataaatatacatttatttatgcataaggtttttttttttaatcccaggccatattttttaaattgacctcctctgcaatttacatcttcatttttctatctgtagctgcttctctctttcctgccaatttacttccttgtcatattaacagtagcttgttaatcttaaattcataagccagtcaatactttattttctaattcggaggtttggttggctttagtgatttctgggtcacactgcctatactaattgatctgtctgtaaagtgcacaaagaagaacacagaaagaggatctttaaagaacattaaataaatgatactttttgataagtaatgcgtacgcatggcaaacaacaacgaatgctacaaaaagggataaaataaaatgtgtgtctcccttctcatcactgtacatactccctggaagaaactatggccagctacttttatgagaaaatataatattctcaaaatttatagtcccagagtaacatttgacaataaatgataacttcagtaaacaatgccacattttgcacttatcatatattaaggcacatgacctcttttcagtatgctgtgacccagggctgtaattatctctgttgtacagataagaaaacagctttatagattgaagattttgcagggatttcagatcctaattttgagacttgacatatacagatatttctgctatgatgtatacatttcaaatgttttgcaaaattatacactaaaattttgaaggttaacagaaaaaaatggacattcagttataccaccataagcctatgtagcaagatcatgaagaaatataatattattttaataaaagtctcagcagagttaagagatgtaacatttttaatagggaagttataagagacaacctttaaaaattttttagaaatacattttattgtgtatacttaaggtatgcaacaagatgttatgggctatgtatagttagtaaaatatttactacagtgagcaaattaacatattcatcatctcacatagtttctctgttttgtgtgcgtgtggcaagaatagctaaaactcagtcatttagcagaggtccctgatgcagactcttcacttcttgggaaatattaagtaagtgtccaccaatgctatccaacagaattttcttcactgagggaaatgttctgtatctgctatttagtacagtagtcacatgtggctaatgatcacttgaaatgtgactactgtgactaaaaaatggaattttaaattttatttaattttaatctatttacatttaaacagctacatatggccagtggctaccaaattggaaatagcaggtgtaaaccaattgatttccactttgtgctgacatcatttccctatttgctcatccatatgagctaattcacgtgctagatagaggtggtgtataaccagtatgctctgttcctttcctgagataaaattggaactagcttacatctatatgctgctagcatagatcaactttgtaatgacaacacaaagggttataataggttataacccttttaaatagaagcctgctcatccctgaacacagcttagcctctgagcttgtgcaaactttctgtatcattaatatgtaaatcttaccctcagtaggtaagctctttcaaaactgtgatccacttagtatgtccttatttccctgtgaataatcttaccagacaagcacattttgcattttaatttgctgtgtgagtttagtttctagaaactactaagccatttaatgtcaatatgttttattagtcaaaaagaatgattatgatttccaaaataaaaattgtctagcaaatacatattaaaatgaattttgtaaacatatattaaaatattttaaatacactcaatattaaatatatttgaactatattatttttcattttgtatgtgcacctagactatcttaaataaaatagccgtcagaagaggatgacaagttgtgcaatgttaaaaagctggagtgtatttaacactacaaggttagacactatagtgttacacagaaaggaaaataattatgaattaaagttggaaacgtaaggtttttataccactcatatatacgattttttaaaggcttgtgggacatggtccatatgtagtgggaattctcaaatccacctgaaaagcagaatgcatgaagatttacaatagatcatccttggaattactttgtctcactacctgttttctcattaaaatggttgcctttaatatgatctgcataactaggctgtaaaatgatgattgaagataaaactaggagcctaatagaatttcccacaaactagttctcctcattgacccaatagttttaagtattgttttaagatgttttcttttttaaaaacatacatgtgaaatggctattatcaagctcattaacatatcctctacctcacatacttacatttttgtggtgagaacatttaagattttttttcttagcattttcaagtgatttgaaactatttttacaatatgttttaacatattttctgaaaaaatataaagtctttagaagagatattctagaacattttacttcaccatttgtggaaactatggatgagtggcagccattgttggcaagtagagagactagtcatagaaaatttatttaagccaatttccaagttaatataggtgaaattatgataggatttaagtctttgtagagagtaagtggaagaagtaaccttatataattgcagagaaactatcagggccagttacactatcccagcagaaatattgcccaagtgatgtcttgcagaatgatgacttcctatatatcatcaagctgaagatgccattgacaataagatacaccattattttcttaaaaggaaaaatgctgtcagttcaactgtgacatgccttcaattgcaaaatatggcctgtgttcagagctgttaaaatgtgataaatatgtccttaaaattacatgaaatagggtaatttttttcacacagattactctggtgcaatattttttgtaaataatgcagactgatatcaggaaaatccttcattctgtacaggtcagaactccagtgaggtttcactccctctgaagagtgtttctaactccaacactgattggaattaggtgcctgtcctgtgagctcctacaacacctgtacacagctccactgaagcttacctcaacagtcagtttattgattttctgtacctaccacaggatttccaaagccctgagggcatatgataaccctttaaaaaattgtacgatagtgcccagcgtgtggttggtgctgaatgactcccatgaaggaacaaatggatggataatacacagaaggggtgctgatgtagtgatgtagtagccacaatgccaaattaagtttttccttttaaactcttccaaagactaacttcccacatctgaatcatgtttcagagacattttcaagttatcctaaaagctataaaatttagtgccctcttggataatgtgatgcagaactaaaacctgaaggtagttacagtgaactaaaataaaaaaatacgtacaagaaaagttgtgattgtgtactgatatggttatgctttgtgtccccacccaaatttcatcttgaattataatccccataatccccacgtgtcaaggaagagacctggtggaggtaaatggattatgaggcggttttctccaggctgttcttgtgatagtgagttctcacaagaactgatggttttataaatgttcggtagttcctcttgcattcattctccttcctccctccttgtgaaggtgccttgcttccccttcttcttctgccatgattgtaagtttcctgaggcctccctagccatgctgaactgtgagtcaattaaatcttttccatttataagttacccagtcttgagcagttcattatagcagtgtgaaaattgactaatatatgtattaataatttatacattttgtttttgtgtgcgtgtgtaatgatccacttgcctttttcactcacacttcgtattaagtgtaacttaaaaataaataagacatgtctgtgtgtgtgtgtgagtgtgtctttaacaaaatgaaaaggaaatcatatttctttccagagaaatggatgagaatgcagggtgcaacatagcataactgagtaaaaggaaattaaaaaagaaattataatattaaaaattattgggtaataataattttgactgggtctaacaggatagtaggacctataaggtaaggaaatgaagatattggaagcagaaaattactgcttttcccctcttaaaaggtaatgataacagaagacgtatagatagatagatagatagttagaaatgaatcaataataaaagattggacaaacattcttctgatgccttgtgatgtaaaactgaagaaaattgagtcctttatattttgtccatcacaacactaacagtttgattttttagatgcctgatgtccctaatttagtcatgtcaatgaatgttctactagggtactcagcaaagttttgccatcctgagttgcgtaatttggatatggtcaaccagtgcttcataccaagatagctaattgtgtgtggtaatatagtgctcactcctctctttaaaattttgtattactaagttatgagattaatgctgctacagttgtaaacaattatgggatcttaagttctttaagactacataaaggtatttgtactatttttatatattcaataacttgctttgtcatatatgtaagcatatatttttgaataattttgcttgacataacatgcatgaatttgctgtgaattaaaggccagtccttatatacatggtgaaatatggtatatttttgtctctggtaaacccacaactgggaagcagataatattcttgtccagtaacactaacttttgggaaacatagtttgtcctagaaatgattgacatagggctcatggttttaaatacttttattgaagattatggtaaatgataataaatcaagaaaaaacataaccaatttccaaatgtcttcctgatttttacatcagaacataatttttatgtacatataataaccatttgaaacaacttttgaattagccaatattttatttcccccaggtgatgaaagtagacacttttatgagtttcttttgcagtgagtttcatgcaattaagtcaaacaagaacaatttttgtaaaccacagactggaaaaattaaatggaagtagtacataaatgattaagagtgcattattaccataagtaaaattgttcatttcctttacttcgttaaaatttttatcatatatatttactttattaatataaactatactatcttagtaaacctcaccaaactataaatcattaaaaaatttttaccaatatatttatatcatgtagtattagaatgtgtcttgctgaacactttataggaacactattttcaacacattcaggtgaggtaagatataattttcttgtatttcctcctaatgatatggttgactgtaaaagaacaataatcactattgtctcaaagtaaataggctttgagactcattaaccaccttagttttgcttcagctattaatctgagaaggcatttattactttgcatattacagtccgatagagaatatcagttaattaattccagtgggagattttggtatcatcataaacaacattttaaaaaataagctaatcttataagaaaatggaaagcgggtgtgtgtgtgtgtgtgcatgtgcgtgcaaagagaaagaactgcaagtaatactgttttcacattcatggaagagacaagtagttatagctcagaaattcacagaactggaggtgacaggatacactttgatacgaagtcagcatatcagcatagtatgacagttaactgtgtaagctctggggaaatcttgggttcagatacatgctttattgatcattagctgttagaccttatgcaaattacttctcttttctaaatctggggtttgtcaacataaactggaataaaaatagtaccccaaaaagagtgtttaaaaaattaaggtactgtatgtcaaatattcacagtaatgctaaataaatcttggctgttattattagatactaggagtccacgtgatataaatgtcttcttcccaatcatatcatgacacatagggaaatctaaaattaaagtgagaaaaacttaatatctcttatgtttcagtatccctatacttggatgtaggttcactggaataaaaatggaatggaaatatctattctgtattcttggaattctggtgtggtctgtctttctagagtctgctagtctaattttttaacacaaagcagacagttgctgtgttttatgcataatcttaagtatttatttttgtgtaattataatttattttaaatatctatctttgtgtttaggcttagtatgactgttttaaatattctgaggtagatggatactgtgcctatgatattgggcaagtaaaattagcattgcttaatcacctatatcatggctgcattaatatcggctccttcatgagctgatattaatttccaaaatagtgcattgtgaaagatgagtggtatgcagaggtaaattactattatgcttgcaataattaaagaaaataaattaaaaattgattgcaagtgtaagttgaaattaatccatatagactaatagtttatccatataaaccaatttattgaaccaattatttattgaacacctgtcacattcaattttctatgttacatctatgctgtgttaacacactaattttatttatgtagaaatacatatttagcaactggagataccgacacaaaccagatatagttttgagcctgaattagatttcaaaatggtggatgccataacagaagtacaacagtgagtcatggaagcccagaaatggatctacctgatcacagacttctaggagggttttcttaaggctctgatgattaaattagagtggagaatatgcagaatactttatcccaccttgggagatgaggaaaagacggcacatgactgcctgtaccattgaaatttataagtaacactattctatgggattaggaaaacctcactgaaagggtgtattaagtcactttggccaatagtaatctggttcttgctgcatgcaaagaccttaaggatttgtgtaccattgagaactaacctcagcttcttatgtaacaagcagaggtgaaggagtgggggaaaaatgctataagaagatcgagtctttggttatgagatgagagtggtgtgattggtcttgacaaatatactctgttcaaataaattctgaaaaggtagccttgtaggaatccaagtaccagaggagctgttattgtagtgctactgcctgccacatctatcttggataatttctccatttagagaatatggtgtcttcagaatttaagtgggaatttgggggccaggtagaggaaatgagtcttcttatcttgcttccctttctctctccctttgccctgcctttcctttcctttcctttcctttcctttcctttcctttcctttcctttcctttcctttcctttcctttcctttctttccttcctcccttcccttcccttcccttcccttcccttcccttccattcctcccttcccttcccttcccttcccttcccttcccttccttctttccttcatgtctcttttaaatgtctagaatttaatattgaatgctatttgggtgaatgggttatattgggagggtcttaataggctcttttgtctccacctcatctgactagttcagactgatcacctggcatgatatgtaagtcaaataaaagcatttgcctttttggtggcacttagggatgacagggaacgatgggcaaggaccatggtagaagtttggaatattcactataagaaaagggagatggaggtgagcaatgatatgcagaaagaatgccaaatagcagggtgttgcaccatgaaccctgattgacccatgagttggttattgccttaatctacacaatgcagcattttctctagtagctctcagaacagagtatttggttggaaggaagtttgagattccaggttgtaatcatgggattctgaggttctaaagttgaatgattttaagctgcacagatgctgcaacatcttgtcctgtacaactttttaagttttgtgggaagtggcacatagtaagtgatcagtaaatatttctgaatgagtaaatgaatgtgtgaagatcattaaagtcaacatgatcaagaaaatgtgagaccagagtgttatgaattaaattattccaatatgtcaatagaagttgagatgaaaaggaatcagatacccaacactcaggcattacttagatatcccaaatccttatggccagtagcttactggatatcttcacttgagtatgtgtaggtatcttaagtttaccctaacttagttagaaattctgattctcatcttttccaatccttctgtttctctaataccacccttatacatagataaaaatggtccctaccgttggcactgtgcttactgtgacttctttcagctatggctcactttttggggcaaaatggtcatatgctcactgcaaggcaatattttcgtccacatcagaaccaagctctaagtatcctgagtctaagagttactttcccaaatggcccattttccacttttggctctgtacagctctcaaccccaggttcattctcaaaaaggtggatggtgtcactagtgtgcataccttgaggctcactaagtgaatatttgcaccggtgggagactggacagaactggatatttaaattggagtgtccaaatgaatgtgagtgagggtactggctgagaaggatatagcaaggtatgaaaaataaagggtttaggctgggggccaagggccagtgttctctgtgcacagagaacacagagaatttttcctgcacaaaattccaaggaatttgaaaattatatatttaagctaagtataaagtttattaccaggtgtttttatgaatgtagaatgatacaacatattatttaatggattattaacttcattattactttttttttttttgacacaaagttgcactctgttacccaggctgaaatgcagtggcatgatctcggctcaccacaacctctacctcctgggttcaagcaattctcctgcctcagcctcctgagtagctgggactacaggcgtgtgccaccaaccccagctaatttttgtattttcagtagagacagggtttcaccatattggctaggctggtctcgaacttctgacctcgtgctctgcctgccttggcctcccaaagggctgggattacaggcatgagccactgcacccggccacttcattaatacttttaaaacacttaagcacatgttgaacttcatttggaaccaagccttgggacccacagatattatggatgagtctaccttcctctaaactttgctgtctcagttgatgacatcaccatccatccagttgctcaagatagatagttagaagttatccttaattcttctctttgccttgctcttattttctgatacagaagccttaagattctggtataaaatgtgtgttgaaattttatgtatttcttcctatatccattgccaccaccctaggccaagtcatgtcatttctagcttagattagttgaaatagtctccttagctggactttcatgtttacaagctctaatccattctctacatagcagttagaagtcatccttccaaaacgcaaatcagatcatgtcacaagctggcttagtccttcagcagattttcattacccttagaacaatatccagattctttgcagtggcttacaaggccctggctgacttggctcctgcttatctctccaaccttgtcttgtttcctcttgatgattacatttcagtcacacagtctttctcggttttcaaaaaaagctttatttgtgcccagaatattggctatttctctctctgcatgaaatttctttcctcagctcttttcactactggttttgtcacctttttgatgtctgagattttattccatctactaacagaagctttatttggcctcaaacttgtgtgactgcccccactcctgatttccaccttcacggtgtcctctttatttcctgtgttacacttagcacagtctcgaatgtgtgtgcttgtttatatgactgctcatctagaatgagtactgcatgaagacagaaactatgtatctctttatttctattgtattattatcactcagacccatgcctgacacatttgtagaaccaatatgctttgtgatgaatgaatgactgagaagaaatgagaagtaggttatttagtgagtttaatagaaggagtggagcagctgatcattatgggtagagcaggagttcccaatccctggctgtggaccagtactggtctgtggcctattaggaaccaggtcacacagcagggggtgagctgccagctagggaactttactgccttagctccatctcctgtcagatcagcagtggcattagattctcataggagcgtgaaccctattgtcaactgtgcatgcaacggatctaggttgcatgcttcttatgagaatctaatgcctgatgatctgaggtggaacagttttatcctgaaaccatccccatctataccccactaaacccctccctgccatccatggaaaaattgtctttcacaaaattggtccctggtgccaaaaaggttggagatcgctggtgtagagtatatcaaaactatgtatttcttttttggttgtttgtttttgttttgttttgttttttgaaatggagctttactcttgttgcccaggctggagggcagtggtgcaatctcagctcatcgcaacttccgcctcctggattcgagtgattctcctgcctctgagtgattctcctgcctcagcctcccgagtagctgggattacagtgtatatacatatatgaaataaatggtggctgggaagcaatatgacttaaaaggagataatttacatctacatctactaccctttcaattgtacttagctgaagacttctttagaaaagttcaaattttttttgaaaagcagtagtagagtgtgtttgaaaaatagagtttatcattgaagttaagttctaatttctctatacggtgtttaagaacaattttcaaaattaaaaatccagttggattgtgaccaagatttagtgacctccttccaggacaggatttttggagtgtggatcacattgcaatatgttgctatcaatatctgttagttgatctcagctgatgtgttattagtgaattaatggagtggactagagtaccttgcatgataggttaggtattgtttcatggaatttgatccagttgtgtgtatgtacatgtttatatttttttctgtggtaggcttccagaaaaaattgtatttcttttttttttttttttttttttgaggcagagtctcactctgtggcctagactggagtgcaatggcatgatttcatctcactgaaacctccatctcccgggttcaaacgattttcctgcctcagcctcctgagtagctggaactacaggtgcagccaccacacctgggtaatttttgtatttttagtagagacggggttttaccatgttggccacactggtcttgaactcctgacctcatgatccacccgcctcggtctctcaaagtgctgggattataggcgtgagccaccacgtctggcacaaaaaaaatgtatttcttaaaaaggctctaataaaaaacatttgaaagccactgttctaggtgataatgattgtaagatctttgtgtatagttcttgctagctcagtcttattaatagtttcattgagagagaattcaacaggtatttgtttgtaagtactaacaaaaaattgtacattcaatacttatcaaacaaaagttacatgatcttattcttccactattaaatttttattttatttttaaattttgattttttggcatttcacctgcaagtctttttgtcttattagagtcacactatgtgatggtattttttctttatccacaatctcccctgactcccctgttactattatggaataatgtaaagttaagaattaattatgattacagtagttatgggtaattaggtactatgaatcaaatcttagaaatcactttcattattgtaatagtgcctcagaaaacaatttttcctctttgactttttaaattgttaatactatcataaatggcatttatgtattcatttaccaaatattgatcaaaaactactttgtgtctaccatcagaatttaaaagacaccttcctagatcatagagaaggcttactgacatggcacatacagaatggtaaacagatagctacattacacaatgagataagtgcttcaataacaatatagagctgtaagggagtgaattgaagagatactcccctattcttaaatgttcagtgaaattcctttgtcccaaagtgctagttaaacgaagacataaagaatagtctagcaaaaaaaaaaaaaaaaaaaaaatgtgattgtggtagttaatgttccagtcagagaaaatagcatagtatgggagatgagggtggaggagggctatgaaatacagtcgcaagaataagccaagttaaataatttaagctccatcctgggtatatagactttcaagtgtgtgagagagcacatacaaaattactaccatagaagaattttgatggcacttttaattcaagtacacttgaccataggtatctgaggtagtactagattcttgaaaagagagctaatccaagacataaagggtatcaactgataaaaatcctgcaacttttgtatgcagttggaaatggtaagaataccagcatttagaagagaatctccaaaattggcagatagaggaaaacacttctatatgtcttaggatagtagggaagagtgcatcatttgctatataaatggaaatgttcatctaagctgcattttgtatgcacactctgtattggtctggtctcataatgctatgaagaaatacctgagtctgggtaattcataaagaaaagaggtttaattaactcacagatctgcatggcttgggaggcctcaggacacctacggtcatggcagaaggcacctattcacagggtggcaggagagagaatgagcgctgagtgaagggggaagccccttgtaaaaccatcagatctccggaaagctcactcactatcatgagaacagtacggtggaaactgtccccatgatacaattatctccacttggtcccacccttgacacatgggtattattacaattcaaggtgagatttgggtgggaacagagagccaaactatatcacatccccacattcaagatgcatgtaagcacttctgcaccattgccatactcaggctccagctttttatggaatttcatctctggctattcattcatccattcattcatacgtgcatacatacctaaatgcatttagtcaattaatcaatcagccattttggtggccgaaatttataaggcaagtaatacttttagtttctttgatagacaccatgatcagaaacatagtctctttcttaaagggaaaataggaagtcttctgagtcataacagatgcatacataaatttctctgagtcttcataagaaacacaagcaagatttcacagaggcagtggaatttgaactgagtcttgagaaataagcaatatctgaacatgtagaatgcaaaataaaggataagcaagtgctaatgcccagagggtaatacatattaaataaccaataaccaattgctacttgtgtttcttacactagaagacaacttggaactatttatcccaaatattaatttccagtttggggtcctgagacagtaacttcaaaacagtcgacattaacttccagtcctttttttcattccagcctataataataatttgtgtagctgcccacatctctcactaaatgttaagataactctggtttaaaatataaataattgaagaataattagatattttgagattaagaaagaggatggaacttacagaggaaagataaattatagttagaagtaaccttgaggtacttcttgcccaatttctcattttacatatgaaaatataaattatgtgacatcccaaggttgggcacaattgtagtggcagagctgagactggaactcacagttcctgacttgcagtgattttctccccatgataaatctgattttgaaatataggataagaagattgcttgtagaattaaaacctgagaacttgagtgtaatataagtgaaatagaaaattgctaaaataatatttacacataattttacttggatatcactcctaattagtttgagaagtaggtaggacataaataacaaataaatgaagtaatgtatactcaaataaacaaagcttaatctaatatagtcctcatatatagggttaattgttgaaaatccactagtgccaatagactgtatataagtatagaaatagcttcaaattcctgatttctaaaaatatatatgtgatatttcacaaaaattattttatggtagctaatataattaaggaaatgtgtatttcattccataagttaaatattttatgaaattctcaaaacaatgtatacatggagagttgcaaccaaccctaaaaataaatattaataaatattgcaggagaatttttgaggatgatacaaatttattcagttaatatggatgacaaaaataaacaaaataacatgattaaacagaactttctggaaatttagtatactaatgaatgttataaatatcctgtgaataatgtgaacaggagcaaattttggtatttaaaaacctatttatttacattagttaaaatatgaattagttgtataataacttactctctagttattctccttagaattcttacaaatcctgaagaaatggagctttaagtttttcgactttcataccagtatagttactactatggacactacttgttactactatttactactaatggctctcatttttgagcacatttttatgccaagcattgtgctaagtcctttctctacattttctcacttaattctaataatattcttgcaagtttgttattatcacccacattttacagatgaggaaacagcgtctcatggggaataaggaaatgattcaagtcaagcaatcattaaatagcgcagttggtacttaggcctaggcctctctgatttcaaagcccatgctcttgacttccatgctacaccacctctgttcagttgccacatatgtacggagcctctagacactaacactcttttggatattagggatgccaagaacaaaagaacagcttcagcctttccagactttctccagaagagaagacatttaactaaacaattgcaatggaatcttacagttgctgtggcagtaaggcataagaacatagtcagctcatcaaagaagtcgtatcctttctacttacaaattccaaggaaaggctttttctaagaagtgatgcttgagctgagactagaagataaagaaatgttggatggatgagagaatgaatagttgtccagatttgagaaaagactaagaaccatgacacggcatggggaaaagtgtagttttcaaattgactgaagtgagaaatacagctagagaaaaaggcacatgtattagcaaatattgtatgacttttattcacattaatcacatataagaaaggttacaatatattccatagttattgagatactgttgatgaccttatagtactgaaaaaatggccatgtttgttctctgtgttcactctgaacgtaaagcgcaatgccatgaaaggggccacactgggaagaagaaaaccagtaaggagaatgtaaacatgactcccggtgagggctggagggcctttttaaagattttactttttctgtttttaaaacatatttcttgggttagatgaacctaagaaaatatatggagttctgtttatttcttacatactttaagttacatgtttacatctgcaaatatctctgtagttgttgggttatcattgtccatcaaactctttcaaagtagtcattacatccttttcaagtgcacatctattgaatagttaccatataccaggccctgtccatgagaagatagttaaatatctaggattctgggtaagactgctcttcctgttcagaaaagttcagtacagatcaggaaactgagaaacaaatataacaatgtgggatttgtcaaagatatctgatatataggtatttaataaataataaaggtgacatttaggatcatcatggaaaaggcagattattccaaaaaaaggctttaataaagccagctaatcatttgggggaaaaaaggtctggtcagtactccgccctttacaccaatataaatttcggatgaatgggatatttaattatgaaaactgaaaataacccaaaatttgggtgacttaccaacccaaaatttggctgacttagaatgtggggggattttcagtaaattataccaaagacagaaatccataaggaaaagacaaatttgactatataaaaacttccaacttctctgctatgaaataacatatacatggtggaagaaaaataactgtgaaagttgtgttcaacacaagtgagagatgaaaggttactatacacaataaaatattaaaatgtattcagacttgctaataatctaaaaagtagaaataaaatgataatgagatatcattttagcctatccaattcaaaactattttttaaaagtaaaggatacaaaatttcagttagataggaggaagaagctaaagagacctattgtataacatggtgattatagtttataacaatatattatattcttaaaaaatgcaaagacagtgggcattaagtgttctcaccacaaaaatggtaactacctgaggtaatgcctatgactgtaatctgactaactagatttagtcattccacatgtaaatatacttaaaaacaaaacttcatgttgttttgaagagagacggtaggcatatatgtgttgtataacaattttatctgtcagttaaaaaagctatataatatgaatgtgtgattatattatattaatatcctataaagtgatcatattataactgtgtggaattataatgatgtcatattttaataatataataaaacagccattaaaagtggtatagtaatattcctgaatatggaagaaacctttcgcatactcaagataaaatttctttctttcctacatttgcattttaaaatttgtattttctttttttctttttttaaagacagggtcttgctttgccatccagactagaatgtggtggtgcaaaatcatagttcactgtaacctcaaacccctgggctcaaacgatccacctgccttagcctcccaaacagctaagactgcagatgtgcaccaccacacccaaataatttttattgtttttttgtagagatgaggtctcactgcattgcccaggttggtgtcaaactcctagccttgagacatcttcccgacttgggctcccaaagctctgggattacagagtcgcattcatcctatatttacattttatatgtaatgcatttttatattcagagaatacaaaaacttccattttgtaggaaaaaaatctgatgcatttggtggagacattttattactatggcagatctgggttctaggtatacccataacattgtgtcactagtgtgagggagctagactaactcccaccccaaagcacctcactcattccagctttggtctgctttaggtctggtgctgagtagacttggaattaatccttgccttttaaatttgagatagcagaaagcaaggactagtactgcttcttagtcaccactctgccacctccattcttccaaccgttcaaactcaaaaccctggagttttgggtgaactttccttttctttgtcttagccaacatcagtactcaccaagtcctactcattcttgcctccattctttttccttcacttggaccaacattatcatattctggggtctcatgggtattgataatgcaataactttctagttggtcttgtttccctctgtctttttccctttaatttatcctaacattgctacttaaattcttgagaatagcatgtttcatcttagtcattttctattaccttttggatggtgatttcctttctttccttacttcagatgaaaactgtgaaacttgtagatggccaactattgttctaaggatgtgcagtgagcttttcagtctcatttgtctgtagtatcctgatgcacctttgattgtcttgccttcctttcttacttgttggcatctcttttacctatttatctttttgtatctctctgtggaatgaagtataaacataaatatcataaggaaaagccagataactccaataattttcagtgtattaggcatttttggaaaaaaatccagagttaaattgtttatacactttcaagagtctagtcactgctaatttctcctctttgctcatcatttcttagctttggcagattggcccatttgttcatttgtcttttgacccaaataaaaatggtatcttttgtagaaagctctgtaaaggatacctttatatatgtattttcttattctctgttataaaatgacatgcttctttttcacatcttcaacagaaataacataatcttgcaagacttcttcaacctgaatccttgagcttaaactgatgaccaggatacaatgtgatataaggattaagtacttgatctttaatgttaagataggaatttattttaaaaagcatgtttcataactgattcagctgggtgacttggggaaagttacttaagcattttaagctcgagtttccttctctggaaagtgcaaccatttttgagctattttccttcatcggaatgtcctttcctttctgtccatctgcccaccttttaaacattttgaacatcttaaaatcaattttctgagaggacatgcaactttacttcattaaagtatttactaaattgcaaaattttatttatttatttatttttttttttttgagatggagtctcgctctgtagcccaggctggagtgcaatggcacaatctcagctcaccacaacctctgcctcccaggttcaagtgattctcctgcctcagcctcccaaacagctgggactacaggtgggcgcgaccatgcccggctaatttttgtatttttagtagagacggagtttcactaaattggccaggctggtctggaacttctgaccttgtgatctgcccgcctcagcctcccaaagtgctgggattacagacgtgagccaccgcgccgggcctaattgcaaaattttagaaatagaaatgttttgctttgttctaagtagcattttccattttgtttattatgaatattttatgacaattgttattcaaagtttgcattcttcagagtttctttttatttaattataatgtgaaaattaattgacaagtgcaattttattttcattttaagaatttgtagcaaaatacacaaatattcagatgaagttgaaatacaggctaagaagtcagttagacaaactgatttggggcaactgaaccactttagacatagatattcattatcagcttcccctcttccacaataagatttgaaatatgccccttttacttcatgtaccaattatatttcagattgccaattatggctccttgaaatatgataagaatttgtattaaaccatttcttgttgctgtaatttgtagtcaatttgatgttggcatggccagaagataacctcagaatgtcctgcaagattttgatgtgtaagttatataaatcatagaagaagaaatccagaattggaatcttgaatattaacagtttaccttagcagagatgctaaaacctcaacacagcattggatagttagtaatatttttagtacatactatgttactaattcaaagagggtgaaactacattgatatgagttgctaaatattatccaatgcatttctttttctttttctttttcttttttttttttttttttgagacagagtctcatgctgttgccaggctggagtgcagtggtgcgatctcggctcactgcagtctccaactccctggttcaagcgattctcctgcctcagcctcccgagtagctgggattataggcacgtgccaccacacccagctaatttttgtatttttagtagagacagggtttcaccatgttggccaggatggtcttgatctcctgacctcataatccacccaccttggcctcccaaagtgctgggattacagatattaccaacatgattccagttcattaaagctgttctcgtggctgtgtttcatttttattaggacattagatagtttaattatatgacatccagtataatcaacttgagtaagatagtttgcaacgtatatattacattttataaaatggactaaaggcatatttggaaagatgagaacaccatatttatcaacaagtttttgcatctgcccagtgatataaagtaactcaggatcacaaagcaacaatatacataaattacagtaatcaaaatttatgttaagcacaggcagtgaattgtgtaagaataaagtatttttcatcagctgaacagttaccaagaatttagattcacagccttggctaaatgacccttccccacaggaagggttctgtggggttcctttattgccattcagtggtgcttgcttgagtagtttgaatctgcccatatgataggcaccttttttattgtataatgatcctggccaagtcatgcgattgggttgccaccttatgtctctagtaaagcaagacactaggatttgtgctgaaaggaaaagagatgcagaaagggcacactggaacttaaagattgctctgtgtgtgccagacacagacattgtaagggctgtggctttcccatcactcactatacttttccaatcaatatcgtcgtgaggtgactgcagtgatattatttcactgtgtcaaaaaatgaagtgacacctaataaaaatgcaaaggaaaaagctggaaaccaaaagaaaatggtttcatgcttcaaacacaggtagaatataataaaattatgggagatgatgtgtacttcaataaaagtttattaagctgaaagaaataatatggtgtagtataatttacttaattagcacctaattagtaagtaaatgtatttggttcttagatggtgaaccatctaggttcctgtaggataatgatggctgtcaaaatttgatctctccaaatatcctacagaaaaatcaacaaggagagtaaataaaactcttttcaagcaagcttacagaataactagcagaccaagaatactgcacattttaagatacttcttaatgggaaataagttacaggaaacctacacagccagttccaaagcccatgctggaaccagtgtaggcagagagagaagtgaaccagggagtgcagcaggattctcttggtggctgggcataaataagatcactcccaagagggagaagtactgagaacagctctggcagctggtggatgagaccactgtgtactagagaatcctaaggaagaatcttaaaggtatgcagagcagaagtgacagtcttgggtatgcactgcctcagcgggagattctcttagaggctgagaggtgaagggaataaaataagcagttggtagaaatttgaggtattaaagaaaggaatgagtatctgaaaatcatatgacttaccactccctttctggaaataatttttttaaatacattttattacaccgaaaaaacaaagttctattgacaacaacaacaataaaattcaaattcttctttcctagacagaccaattttcttgttattgaagaaaaccctcagataatttaaaataaatagaggaacatcaggctgtattcaaacaccattactataagaagaaaacaaaaagtaagtcttttttaatctgatgattatgattcccaaatacaacccacaactcagaagaaatattattaagcatttgcatatgtgaaagaacatttcagattgaaaatttaaaaactgaggagatgaattaaagaaaagctgaaggatgtggcataagagttgataaaatcaggaaattgaagagaaaggtacaccaaaagaggccaaagattttttttaaaatgaaagtaattggaaatcagctattaaaatatgaatctaaaaaaaagaagaaaaaagtgcaaaaacaaaacaaaagaaaaaaaacactaaaaaatttaaaaacataaaatgtgaatatataagaagaaattaataaccgtaatgttaagctgaattgcttgtaaatcatttaataagcataaaatattttgtagaatgacccacactttctccttcataaaaatataatggtctattatcagaggtgaggtacacatttgttttcagacagtacgacattcattaatgaattaaaaattgggaaatatttataaaatatttctttgatgatgtccagaaattgatcgtatacatattatgagggaaattattttgttgtaaatattttcattgcatgatatctgtccatacatatatatgtatatagatttttttttctccgaagactcaaatcttcttgagggaagactttgttctttatttatatttatatttccagaacatttcatgatgccacatgcatcctaggtgcacggttaaattaacatttgctgcctgaactgtagcatatatcaaccagctactacttaccttataactgcgatattcatatttttagtagagagaaacttgttattttattatgtcttgaaattcatggtgaacctggtgagtaagatcagagagggcgttgactgagcttggcagagaagcaagggggaagataggaaaagtgatgaaaagtcaagccctttgaaggctgtagtggtagggtatgagagaggagagggaaattttagagcttcttccatcaagcttagtaggagtcagcacatccatgtgggcacagagtgacagcaattcagaaaacaggcatggtggtggctgctcacactcagtttgtgacttccagatctgtaattaatataatgaattggacatagtctagttttatgacaatctatagcatgcatcttgtttcttgttacgagtttacaagttgtggctcagaattagtggttctactgtggaccatggggctttacctaggctgacaaggaggtaaagacatcttataccatgttaggcaccataatgacctgagatgtgcagcagctttctgttataggtgctgatgaactatgcttcaaaatggcttgaggctacataaccacattgctagtttttctcctcttgatgtatggtttgaccattccatggttagtaggtatacagaaaatgccttaaacattatgatgtttttattatagagaacagaagaaactctcaccaactgaacacttacatagcttataattcatccatggacaactcaaataaaacataacttgataaatataattgagtcccctcatgcattgaataaatttgggtcattttctaattctatcagaaccaggaaatgtaacaaaatccaactgtaatatgcttaagtagaaaaatatacctcagttaataatttaaaagagctgcatgtgtttatacaatgcctagccgttacatgtctcagaccattaaatctctatggcattatcacagtagttacctcatttccattgtacagatgaggaaactgagacataggttaatagcttactcaaaatcactcagatagtagctgccagggtttacattaagacagcgtggctcggtggggcgtggtggctcacgcctgtagtcctagcactttgggaggctgaggcgggcaggtcatctgagatcaggagttccagaccaccccagccaacatggtgaaatgctgtctctactaaaaatacaaaaattagccagacgtggtggtgtgtgcctgtaatctcagctacccaggaggatgaagcaggagaatcgctggaatctgggaggcagaggctactgtgaagccgagatcgcgccactgcactccagcctgggcacagagtgagactccatctcaaataaataaataaaaataaataaaaataaaaataaaagacagtctggctgtagtgtgtgtgccaaagtactgcagcacatttggtactttctacttaaaattgatttacacagtaaaagtgacagaccaacaatagaaagccaatgttttaattcattgtggaagaatcagtgatagcaatgactaaatttttaaatattatttgtcactgtttgacaatattattgtagacacactaaatttatatattttctaaaccagaattgagacaaatgagtaataaaaacttcccacagtctgtacatttagataaaacaggtaaaaaattaaaaagcaattatacttttgatgttattgttttttaaaaattaaataatgttttctagaaaattgttctatttaaaattctctttagctttgatccttccaaaattccaattaatgtcaattgaggtattgctgattttgaactcttcacttcttgagatctagaatatcgaaagtctggcctctttcttgcaatcagttctaatcagcagatatttattgaatgcctattaagtgcaacactgttactaagaaataaatatcttcaaataacatgcattcttgtagggaactttcattcttcaagatgatagaagaaatgtcacaaggtgaaatatgtgaattcatttccacatgaataaaacagacaggatgtactatggcatttctgaaggagaggggtctttatacttcagcattatggataaaaaaagttctcatggaaagaccaacttgaattaggcatttctaagaactttttaaccagtaactttaaaacactttccagctaagttgtagacttttgattttaacagacaggaatagaaaagatgtgataaaaagctcaaatttgagaatgaactatatcccagtaacagcattgagtgttgacaaaaagatgtgttcttttaaaaatcaaagcaatagatacacatagcttcagaataaaataatggcaataggtttataaacagagtcagcagacacctacctcattccctacctcccttggtattaacagggaaaaattctattaaatattaattttaatatttagctgtgtgtattaaaataatacagatatactgtcatttctaaatatatatacttatatatatttattttggacatgatctgttgattttttgttatagtacttactttgctcacttaaaaaaacatacacatacacacgtgtacatgagtgcctgtgcacacacacaagtacctcccctccatatatttctccaacaaattcattctgataagtttatggtgaggtgtattgtcagtattattgccgttattcccatgtgtctttttttctttctctatatagtctctgcttcctcctggtttgattatcctgcttgtttctattggactttctttttcatgttggaatacctgataatccctggttacgttctccattaagagtaaagcactgaaaagctctgtgtgcttggtgtggcggctggagaatgaagagagaaagtgataggctttccagctgctgagtgtgatcagtgaattggactaaaatctgtatggagggcctggcgcggtggctcatgcctgtaatcccagcactttgggaggctgaggcaggcagatcacgaggtcaagagttcaagaccagcctggctgatatggtgaaaccctatctctattaaaaatatgaaaaaactagccgggcttgggggtgcgtgcctgtagtcccagctactcaggaggctgaggcaggagaatcacttgaatccaggaagtggaggttgccatgaaccaagattgtgccactgcactccagcctggacaatagagggagactgtgtctcaaaaaaaaaaaaaaaaaaatctgtatggaggaggtcttacaaatattagtaaccacactttttgttttttttcttcaacttttcagttttggggtacatgtgcaggatatgcaagtgtgttacataggtaaacatgggccatggtggtttgttgcacagataaacccatcacctagacattaagcccagcatctactggttattcttcctgatgccctccttcctccctcccacacccccaacaggccctagtgtgtgttgttccccccatgtgtccatgtgttctcatcgttcagctcccacttacaagtgagaacatacagtgtttggatttctgtttttgcattagtttgctgaagataatggcttccagttccatccatgtccctgcaacagacacggtcttattccttttaatggctgcatagtattccatagtgcatatgtaccacattttctttatccagtctgtcattgttgggcatttgggttgattccatatttttgctattgtaaatagtgctgcagtatacatgtgtcattataatagaatgatttctattcatttgggtatatacccaataacagaattgctgtgtcagattggtatttctgcctctaaatctttgaggaattgctacagtgtcttccacaatggttgaactaatttacattcccaccaacagtgtaaaagcattcctatttcttcacaaccttgccagcacctgttgtttcttcagtttttaataattgtcattctgactgctgtgagatattttgattttgatttgcatttctctaatgatcagtgatgttgaggtttttttatatgtttgttggctgcatgaatgtcttcttttgagaagtatctgttcatgcgctttgcccactttttgatggggttgtttgttttttacttgtaaatttgtttaagttccttgttgactctggacattaggcttttttcagatggatttgatagattgcaaaaattttctcccattctgtaggttgtctgttcactcttaagatcatttcttttgctgtgcagaagctctttagtttaattagattccatttgtcaatttttgctcttgttacaattgcttttgacattttcatgatgaaatttttgcctgtgctatgttctgaatactgttgtctaagttttcttctagggttttcatagtcttgggttttacatttatgtctttaatccatcttgagttaacttttatataaggtgtaaggaaggggtccggtttcaattttatgcatatggctatccagttctcccagcaccatatattaaacagggaattctttccccattgctgaagatcagatggtttagatgtgaagtcttatttctgagttatctacctgttccattggtctatgtgtctgtttttgtaccaataccatgctgtttggttactgtagccttgtatagtttgaagttgggtagcatgatgcctccagcgtgtttttgttgttgttgttgttgtttcttatgattgacttggctatccaggctgtttttttgttctgtatgaatttgaaagtagttttttctaattctgtgaagaatgtcaatggtagtttaaagtgaataacattgaatctataaattacttagggcagtatggccattttagcaatattgatttttcctatccatgagcatggaatatttttccgtttgtttctgttctctctcacactttttttttttttttttttttgaggtctatcagtcagcttttcagagtggaacaatgtagttttcaatctgggaggtatgcatctctctactcatgttctggaagctagatgagaagaaacagcagagttaaatatgtagacatcagttaattactcactttcccaccctccatatgcatttattcatgttttaatttgcattgtgctttgctgtgccgagtttcctccaatccatgatctctcagattttctttttcaagagaatacccttctagctgggctggttagtcacagtgtagtggcatgaaagatcattacctggcttcacagagttggaatcttgcactataagttaggagtctgggaggatataagtcaggaggacatgcaccctctctttggcatttccctttgaagtcagacttagtcagttgctattattctaagacctttccatcaatgtaaatgaatataggtttcttacttgttcttgtctttctcctcttcattttttctatgtggcttagtaaattattttttttctttactaccatttagtggctttggggcaggggcaggagattaatcatgcatattcaattaaatagaagcaactatgtatcttattaatatgattaatatgattgctattccctataaattttccagtaatcctatgacattatcccatttagtggatgagtatattaagattcagctaaggttaagtgacttaccaaactgggtttgactcaaagatacagaaacataagaatacagaattcttaacattttaattaaggacaaaagtttagtattcttttcccttagataatatcttccaaataattttgatataccaagcaaacagtgtacatgaggttatacaacattccattatttccctttttacatttatctgaatacatcaccaaagtttctgaacaacctgagtagtcagaattgtaccacaggaaaagagtcttcttccttccagttttcaatgtcactttatgtcacatttctttaagctattctgaggtacaaaccattccactttttgcccactgtactgtcttacatctgctgcactatttctttttgtcaggacagcacctcatttccaggtcttagttgtctttgttgttaacccaattacctcaaaaactgcttcaaacaaaaatgatcatttattatctttcacattttgtggattacaaattcagacacatcacagtttctgtggatctgctgggagaatgaaaggtcaggagcttgaattatcagaggtttccttcacttatatctgaaggtggattcttgctgttagttgggacttgtgaagatggtgaagggtctgagattttgccagatatgtaaactatcatacatgctggcagaagacacaagattcctgagtcagagacaaaagactttattaattaaggcatagaagggagagtgattttcaagttcacgcaattacccttgttcttaagtcctacaaggggaacatggagtgactcaggtggatactgcacatatagtatatatgcttcatagatgagcaaccttgagcttggaaaatatcaatctttgcaatgggctggaagtgaacttccttgaactttgcactgaagggcaacatgatcctctgactggtcagtaaacaaatctacccttgctctagagagggacgctgtttctgtcttccagggttctctggtatgcaaaattctcggaaaggtaatctggaacaattgtctctgctagcaagatgtgcagaaacacaaaagactcattgagaagtttctcctcataaaatgaaaggaggacaatggactttaaacaataattggcagcttctgaagtgtcttttaggacagattcatatgaacaaataattttaccagattgtaaaaaatgtagaggaatttggactccttagattggtggtccaaatgaaaggctgataaattctgcttgggggccttgattcagagaagacttcaaatagaaaatgcttgaaaggagcaaattagataataaggaaatctttacatactctattgctgttcttattgttgttgtcattagctgtttaagcgtatgcatatgacttatcacatctaagatgcttgaatagttttggatagcatatattcataagaacatttgttaacattaaagtaaacttctagcctggagaagggtagactcaggggtatgcatgatagcatgtttaaataatctgaaggaatgctgtagggtgggtggagtgacaggtttaaactgctccagaatacagaatcaggatcaatgaataaaggttatgagaaggctgatttaccctcactacaaagaagaacctttcaataattaaagcacagcctgggaggaatcttaattgacaaagagaaagtgcagctttgaaagcaaatgcagagagagcttcacagaaaagagagcatggaaaaatcaagccctgaataatgtaatatcatgtgttggtattcagaagccaaaggaagatggtaaaatggtagcagtgacagtggtcctgggagagagatgttctttggataatttcataattgggtaattatgccaagaacacatgtgtacccccaagaggtagacaacagcaccagtgaagacagatggagctgacttagagtgagcttttcccttccttcctcaccctgcctcattctctctctttccttccctttattacttttcccccactttcacgatataaatatctactttgtgtcagacactatgctcagacctaaggctatagtagtgaatagaaactgtttttaccttcaagaaacttacaagttagtaagagaaacaaaacaaatatatgacaacaaatcataataatttgcaagggagattttcaaggaagaaacttacaagggacaaccaaattagattgaaagactagaaaagcttccctgaagaagtgatatttaagctgagatgtaattccaagtaagaattttccaggtatagaaagaagggattgctatggaaaatatgataggaaagaccttctcacaataagaaactgccagaaggccaatgtggttggaaaaaagcgcctgtggataaatgatctgagaagagactggagacttaagcaggatcctaaagcagaactgggcttctgcttagaggactgattggtgatgaggaggtgtatagagggctgaccctccaggaggctgttgccacagtccaggtgtggtatgtaccaaatacctggatgtggaggaggagagacatgggtggatgcttttccacaccaataagtaaaacaactgaccaatctccaagcaaaaaaaaagtgatcatccatcagtattattttctaattgccatcaaatgtctatgaccctcagaaagcatgatggttaacaatacagactttggagtgagattggctatgtccagatcctagcttttgtatttactagttgcatgaacttgtgcagtctggccttcagtgcatatacctgtaacataagctgcatagacatgtctgttttatagggttagtgaaattatccaaatggcgattatccaaatcacgatggtgatttatggaaagacatcacaggcaaagtatacaagtttctttaaagaagttaacaagaactgaactgggtagaaatggttgtacaaagccagaagctttccacattattcctattagaggagcaaatatcccatgccattcaagtatgtcaaatgtgccctagcatttattggaccattaggtttttcttggtgtttctttatcattcttctgtgatgtcttaaacccttttggtttgttttaatatttatgtatttcttaagaggtacatgtaactggtaggcacactgccaacacattactgaatttttctcaaggttaccataccaagtgtattatcctttagcaggccaaatattaggttttcttgaagtttattcctgcaagtttgtgcaacaatttaatgacacattttaaatttaaaaaaaaaaaagaaaaaaaaacttggtgcaaacctggaaatttgtaaatatagaataggacgcaggctttaattactagtgaattgttaaataaatctgtttggtttagttttggttattctaaattctattctaaaaagaatttcttgtattattttccaagagcttataataaagtaccccttcaagtgtaataatacagacacgtctaatcgaagtgagccagctcaccatctgctcacagttctgctacttaagcagtgataacactaaaaacagtctgccagagtttcagttatgcaaataaaataaatggtgggactcagactatcctagctttgcattaatttgtgtgtcttcagaatgacaccaaagtagaaacagttcttctgtgtattatgtcaaaggaatatattttataaaagctctctgtcaagtggaaaattagtttcaagatataaacagtttttgtgcttaagtttactaaactaataaattttaatcatgataattacaacaataatatacataaataaggtacgtacagcttattcctcctttaatttgcttaggggagggctttatgtacctgagaggaaaaaataggaggattaccaatttatatgcttggtaccaaaatatgtgattaaatttagttggctacatcaggccatcatgagatatctctttaggatgctcataaataaattggccaggtgtaggcttacagcctgaacaacatttcagggggcttatgggagtaaatagaagtaaagattagtcagtagtagtcctattcagcaactttatcaaacctggaccaaataatctcctgataggcaaacaatgccgtgtctttcccaagggatagcacttgatgtgtccctcttagtacacctaagagctctttgtggtcagaattcatacatcattaatgattgttctaatattgtttccacaaaatggtaacagcagtaatttgatgctgtcttttgttgcaaatatagtctgcttttgcgtaatccttagtcatcttgtattctccaccaaaactttctctcctgcttttagatttacattgtgaggctgtagatggagaaaacattcttcctctcactcttctttcttgttatctgttctgatgctattggacattttgggttgagaatctatcatattgaatgttggcatgaaatctgtgcattattcaaactcatatttaactcatatttatatgcttccaaaatgaaagcatataagtagcagcagtttcattttgtggaaggatttacattttccttttgagttacagaatataaggaagaaaatcaacaaagtcttcagagacttgatgttttaaaggtagcttgaaatacctcaaacataaattatccagcttgattatgtcaagaaaaaaagaaagaaatatcactttgtagtcatggttctctttttatatatttgtttattttgtagtcatggaacgagcatttcttgaacaaaagtagttattcattatgataaaagggtcaatattattttaaaaagaactgtgttggcaatattgaggcagcgtaaaacaatattggaattatttaaaatattgaaaaatacaaaggagatgatattcaagaaaccctaacgtcacaaaattgggtaaggaattaaaggaagattgcctggaacttgataaattaaattaaaaagttgttatttatgttgttcctttttcctactataatttcactgtatttagccaggcacagtcagctaacctgttagattgctgtaaaatttgcaagacaaaacttgtacaagagtttagataaatgtttagacctgacctatctgagttctacatcattgagaagaaaacatagtataaccctcatttaaaatctctcctttaagatagtccagcaacttatatccataagcaattaaaatttgtaactttatcaaaccatttttgaaataagtgattcttttaactttatttttacaattctacaattttaaaagccaaaacacaattacttgagggaagtgataaaggtgaatgaggaatcctatagtcttgaaactgaaaaatagttgagtacatattttctctgcactttatggaagactaaactgaattctagaaaatcagaagatgcctctagattgttttcaagccaagaccacatgggcatcttgatgtcttagagagtatatattctactgcactatactacatgtagaagattctaagtccattgaaaaaaattaccagggagagaaaatataaaataaataatagtacctggagttaatgtattgttaattttgagttcaaaggttttttttttcctatatgcacataaccaagctattaataataaaataacaagaagatataaaaaggtgatttttttttagtaagtaaagtattttgaaaaatgttccaaaatttataaaaatattggtatgggatttctaattttattcgtgtttcagattaatttattacaatatccagtgtcctgctttattaaacagctgagacaatacagaaaggaaaactagaaattaaattatctatttatgccttttaattttagggaaacagaggcttcatagcactcaaaaaatttattatggccgtcaaacagcggttcacaatagtgttctaaaatttaaaaaaatctttttgaacttcacattacaatgagcaactgagcagatggtactaagaaaagcttcaggtgtgtcttcctcttttatacatattttgtttaatttatattgaaatgcagtccagagatgttatgtttcgtttttattttattttatttttattttttttgagacagagttttgctcccattgcccaggctggagtgcagtggcatgatctcagctcactgcaacctctgcctcctgggttcaagcgattcttctgcctcagcctcctgagtagctgggattacaagtgtccaccacccagagacataatggccatttttgatattgttatggacaaaactttgattggtatattaattataggcaatttcaagatagaagtatagaattatgtgaatttttgcttagaagaaaatgaaagcaaataacacatacatgctgctgaattgcttcaaaaaattatatgcaaaaattgacgctgtagtcaatgctggttttccttagtatgaaaaaggtgacttttcagtctatcatgtactttcttggagacttttactaaagatttatctgcaaattaatggaaaaatagggtgtaatgaataaaaaaagagaaccaaacagccccattttcactccctcaacctttggctagaaagtaagtattctaaaagttatactttggaaccatatctcctgggttgatcttctactcagttttagcatgtcagttgatttttattccttcttgcacagttatttgttcccaattcttcaatattaaataggttcttaaaattcgaaaaggagtaatggtgaaacagtgtttccaaaacacaacatgacaggtaaggagttctaagaaacatttacaagttatttttgactgagaatgccttttttacttcctacactcttgtataaatgtagatggggaaggcattattattttctttacataattaagaaaaccgaagcagataacatattaaatgatggcttttgcagcatcaaggttgtgaaatgtagacctcagaggaggactcagaaattctgctgtccagatcaagtttccattctatttctgcaaagatactgtcttgggatacagaaacaaagttgttagtatatttattataaattttgataggaatttactttcattgtcaaatagtaaatatgctgactcttacataataaaattgtctccttgacaccacttttgaattacggtcattttctggcagtgcaaactgttattttttttttgaaagaagcaagttctatctaattttagagtctagagtctatttagactgatactaaacaaacacacccattaaaaaacattccactttgtctgaaattgatatatttgtccttgagtgtacatttcgccttacctttgtatgacattttcttttatggtgtttttgaaaactgcatatagttgatttttattcacaatctgaaaatatttgtattttaataagggcattaatccattgacttttactgtcacagctgataggctgttatatttgctgttttgattcgtgccttttgttttttgtgtgtattattacatttgtttttttcttttaatatgtggaatttattttcatttctttttttttctctaatgattggggggaagttttagaaagatttattttccttttcaaattctcctggtagttccattttagttttttgtttgtttgtttctttacttaatacttgaacctatatttctctattaatgttaatgaggatattatatcaacttaatgtatattaaatgggggaatctgtactctttacttcccctatgcccttaactcacttgtttcacaggttttgttgatatatccttatataacatggaaccgttatatttttatctttgagtccaaaatttttacaattacattttgtggtgcaccctatttgtgacaaacattgagagaaacctccgcattttcactgttttcaacatagtctaccaacacttaataaactaggtcttccctattactatcatttattttatttataggtagccagtgctcattttttgatatatttttcagagttacatgaagatattatatcagaaatcaaattattttgcttcagacacaaattaaatattaattagttataaaattctccataaactagaggttaaagaaaactcacaaacgcctacacggtacaagctggaaatgtaaattgtgaaatatgcctaatgtaagatcataggtaaagtctatagcatgatgcaaaggcgcagacctattctgaaggcattcatattcaactatgtatttttaagcttggatagaaaaaagaaatgacaacaggccatttagggtcacagatagctagcgttcctgtagacattgcttgcgtgatctttatcatttagtggtgaagagaagtctgaggcaagtgtgattcctggtgcacatgacctgcttttctctacctgacttttttcattatcctcaaagaactagaaaaaaatccctgaaataggcctaactgttgatggtttttaattaagttgatgtataattgataaccccttcagttttgaaggttagcattccaaataaattatttaatttttgaatgttgtgtctgtgccatgtgttctgctgttttctttaagaacatcaatatcctatgtttcatttgcttccacatagctttatttccttgcataatgtgagagtcttctcatttgtaatttatattgtaggtttagttttctacataaggactttgtgtatggcttctgattttgtttttgccattgtacttatgttgactaaaactacttctttaacagcctgtgccctttatttgatatatacatacctttcaaccaatattactgcccttcttataaatatgcgtttgtgtgtatgtgtctgtgtgtagttctgcagtttttttttttttttttttttttttttttttgagacagaatctcgctctgttgcccaggctggaatgcagtggtgcgatctcagctcacttcaacctccaccttccgggttcaagctattctcctgcctcagcttccctagtagctgagattataggtgtgtgccaccacgccaggctaatttttgtatttttttttttttttttagtagagatgggttttcaccatgttggccaggatggtctacatctcccaatctcgtgatccgcctgcctcagcctctcaaagtgctaggattacaggcgtgagccactgcacctggccctgtagtctcattttactttatttactgttgaatgaagaggactttccatgtctgttatttgaatagtaattgattgagaaaggttctaattgtcctgctcttcaacccccggggtgctgttacagttcttgtatcagaccttaaaatagaaaagaagttgacaggtaaacattcacatcatcctttttggatcttgtttttgcataggtataggtctcttgaattaggaaatctctcagttacctctgtctgtctaggtagagtagaatttatgcttggataatttaaaacagtatttcttcctctgacactgttgatacagaaaagcactctcacagtttttcattgcttcatccttgcctactgccaatctcttattccaacatgtgacatactattgcctctccacttcagctcaatccatattgtctatctggaaactggtgttgctgaatagctgaaaatattatttctcatatttttgtaaataggttgacaaatgcatcatgatatgttcagcactgtactggttttagcactgtaaatctcaagtcctggggaccgccacagttttaggcaaaccaaataattgtccactttataagcaaccataaaatataaacttcccagagattgtaacttctagtagaccatgttccttttacctcattactaacattatttgcctttttaatatcaacactagctaagttaattttatcttctgttgtatatatttttaaaaagcagtaaactattttttgctttaaagatataagattaaattataatattaaatgtacttgttcaaattgttggtaccactctaactgaagcaattctgaaacttggctagcctgccctcaaataatgtagtcagagaagtacaaatggaaggaaagtaaagatgaaattttgtctccttggctagctgttctataaaagtctgtgggatctgcaagccctgtgatcagtgaaacccttgtgcctttgacactgggacatgtcatggtaggaggggtgagtaaattttcctttacttggatttagcttgagtatctttcctgagggctccaattgcctttggcttgtgaaaattttcctgagttctacaaattaatatgtgggaatgccaaagtttgtgtgtgtgggagtgagggtggtgtcaaatggaatgaaaaagtgaagatgtaatagttcgttttcacactgctataaagaactacccaagactgggtaatttatgaaaaaaaaaaaaaagaggtttaattgactcacagctcaccatggctggggaagcttcaggaaacttagaatcatggctgaagacgaacggggaacaagggaccttcttcacaaggtggcaggaagaatgatgaatgcaggaggaactaccaaacaatcataaaaccatcagatgtcgtgagtgagctcttatgacaacacgaacagcatgggggaaactgcttccatgatccaattatctccacctcgtctctcccttgacatctgggcattatggggattatggggttacaatcaaaatgagattttgggttgggacacagccaaaccatatcagaagggtaagtcagtttcgtatcacaaaatgatatgtgcttaaactgaaagtcttaattatttaaaaaaacttatttcagtaaatatttgcagaataatttgtatatgtaagctactatgctagaatgtgtaggacataaaaatttagatatagactctgcctttacagaactttcttatagtaagagttaccaaacccactgcaaagtctgaaatgtcatgtaaaagtaatttgaaagtgctgaaaaaatatagattatttttgattggtgaagatcatggaaaaattagttaagataatattaaaagatatattgaatttaaattgacagaatttggggaaacatctcaaacccttagaataatatgtgaactgggtaagttcaggatgtatttggaaattcaaaagaacctgttttaactggtgcttcagatcattgatggaagttagtgcaaatttttctggaaagtttggtcaggaccagtgggtgcagagatttgaaatccagatttaagagtctgacattttttttaatcacttgaactttttcacggagaaactgtgccctgtttatctttctattcatcaaacattgccgcagaataaacactcaataaatatttgtgcaaaaataaattactaatgacataatagctgcacatctgaaatgactgtgtctgtgtttacatgcacttatgtagagttttccccggaaaatttatttacatttttcaaaaccaattatatggaaatgaatgaatgaatgagatattgcatataatttcactgtagactaaattagaagatattttttcccttttataaccaggagcataactaaggataccacttagcaaaattattatgattatgagtaaggtttcatttaaaaatattttgaaaggcatagacagagtatcatgaaataatctgggtgattgtaaaataaacaatttgcacaattacaggtccaccgaaggccagagctgcaaagggtatgtctgattgctggtgaagggtataattatctctgaggttgggaagggttatatgtgctggcttgtttgccaacatctgtcagctgtttctgtgtaccacattttctgttctagttttgagtcttaatataaagtcttcaaatattcctggcaagagtagagttatgtatatgcaaaaatatattcaggtttgtctcttaacatatgttcttacacagagaataacatttctactttctgaacaacatttttaattttctagcagaaacctgtattttgctacctattttcattaattcaagttgtgttcttatatcgaatagcaggtaaggggcttcctatgtaccaactgagagtgatttacattaaaagacattccagacataaaatcatttctgaaggttatacttcctgtcctgaggacttttagagtaattttggcactacttgatgtccttatcttggctgtatccttaaaatagtaggctctcatgcagctgtggtagagcaagtgaactggacttaggtaacagaaatttgtctgaatcagggcaatgttatttattgactttgtaactttcaacaaatgagttaacctctttgtgtctcaattcacttttcttattctaagggccttaaatgaattaacttatttaattctcagacaactctagggaatggtaccacaacggtcatgctcactttctaaattaggaaactgaagtagaaagaggttaagtaatttacccagacaggtgaatgcaagcataagaattgaatcgggcttctgtcccctgatccataactttacccacgttcttctgtgtctcgctaatattatctattttattattttgaggattaaatgagataatttctggccatggcagatatttattatattggtttaatatacttattaaacaaatataaccacgatataaatataatatattcattaaaccaatataaaatattaaaccaagattttatattggtttaataaatatactgataagatatttattattttggatatttattagtttttttactcttgagtataaactttggagaattcgagattttttttaaagttaatttttttacaacaaaaattattcttgataaacttgctgagaaaaagattgcgtgaatcatctggtcagtaaatgcaattagaaaatgttcaggtggttggtagagccccactttcagcatgaattgctttatagagcattaggtcacagattattgaatcttataattacagaagaaaatttatgcaggatttcattgtttttgactacttaaattccagttaccactggctatgcctggagttgaagggtcatacttaagagcaaagacactttgacaaaatgaagacccacttaattacttaatgggactgcaaaataccaggtgcagccataaaatgctaaaagttcatagcaggaaaaccttttggtgttacaaattttcatcaacatcgtcatggagatattaacatatgccttctaaaaccaggtcagaaattacatcatgcctggtttgtggccagttgttggcaggctaggagtaactctagagcgttaggcaacagacacttgtcatactcaaagcatcttttctctgtgtgattgcataagctatctaactggaaaggtacgactcctgaagctgcattggcttggttttcccagtgaaaatttaaaataggcaaaaatgtttgctacaaacatcagtttgtggatatttaaaacttatttgctatttaaagaacaaattattttgtgaaaaaaagaactgtcatttctagatgagactatttggataaaactgcctttaagcaagttggatagtaacaggaaaatatttcagggacaaatagaaataaaaaaggagttttggactactgaatttagagttcttgttgggtatctacacgaaaattctagaagatatctagacatacagttcttgaacttggaaacagcttatttggtgtctgaagcctgggggccgaagtagccacatgtacgtagtgttgtttatcaggtgttcaataaggtggaggattgtggtggtggggtttacttgtggtcctcttcctttatctgtttgtctcatcagtaatttagatgagcacagataacatgggtgagtttctcaggatttcaaatatcataaaaatgcgtggcataattaatatatgacaaaatcagaattcagtaaattttgactagaatcagtgtcaacaaagtgaaaatttaaaggaatagatattaaattctacatttacattgaaacagtaaatacagtcctgcagaaagattagtgaagccacactttaaagtgcttagttgaagatgaactaggtgttcttttgattacttttttttttctcacaagtggcttctacaactcctcctccttgcccaaataaacaagttgcagtatttgattgtatcaaaaaaaggcattctttctataatttatgtctgggactttgcatattgtttctaattctcattcttaagattgtaatacagtcagagaaattacagtagttttaatggttggaaagtagattatttgctgtaaagatgatatatagatgttttaagaatttttttaccagggtgatattgggtgcatataattcaacgattgttactgtattgcctttccccacagtcactttttaacattttcccgcaaactcattcacatcattgtctttgaaagttcaggtctagagatacctcctctgtgaggacttccttaatattcccaggtgtgaaccaatccctcttttgtgttctctttgtgtttctgttctatctttattgttttaggacttaccatattgaaagacattaatttattgatacttgcgtctgtctcctctagactgcaagggatgtgagaactcagacctcatcttactaacatgttatttatgtctgtggcctaagtcttagctcatttctgacaatatgcttttgtaccaaattgaactgggggcataatagaaatgttccatcgttctctggaggaaagaaatagggccagagggcagaagtgacaaggacacagattatttaagctcattactaataattagagctgtctgaaaatgaaatgacccgcctttacaatgtaggtcaagcacaaggtgaatgataatgcagaagaaatgttgcatagcctgacctctaaattcccctccaacttctgtattccatgccttacatttttctcttgtgttattaactaccctcacaggtagtcttcaaaagcactttcatatatgttatctcatttatttgaacaaatttcctgtgatgtatgtagggacaggtattatcattctaattgttcagtaaaatgaggcataaagaagttaagcgacttgaacagggatactcagcattaaatgtgagaccagaatacaatcttcctcatggcagtttagtaatttttttagatgaactatctgaaattatcaagtttgcacattttgggggacatagtgattcaaatattcattaaataatatgtttttcctgattatgcttgtatacagccttgtgtttttgtgatcaaactactgtttatctttttatcccacctttaattttcatacttactgatgattctcaacagccagaaaaacaacagaaaagtgtataatataaaacttagtgcctaaaaaaagcagtgataacatgctgtgtgtttcagcagtctggttgtgtgatggaagctcatgaatacacacactgcgttccctttcaggatccccaagaacggagaccaggctgttgcaatttgctcatctgatttagcagggatatctgagttcactgtattccctggaaaggctaaagatacagaagagtcattctggcttgcattaaaaactgactgtgtattttattttattatggtctatctgggtctggtctggcagctatacaagaaggattgcacttacaagttagatatttcctgaagaagagttaagaccatgtgagaaaagttaaccgattatttctgatacttttttctgtaaaagaaaccacattagccccagaaacatgcaatttacccatgaaacaaagctgcacatgtgcctccagaacctaaaataaaagttggaagaaaaaaatagaaactgccttaaaatttagtggcttaacacactggcaattattttttctcatgatgatgtgtatttattgttcctgtcccaggaacaagaccacttagagtggtctcaggtgtgatcgctcatgcagctacaagtcagctggtggtcgggctgtggtgtcagctgaagccccttagttctcctctatgtggcctgctcagacagctagtttgtgccaagttctcagagagagaacatggaagctgccagcctgattaaggctcagactctgaagtacaggaatgtcactttagtcacgttctcttgatcacagcaagtcaagtcactagcccagctcaaattaaagaggagaagttgccttttgaagagaggagcaatatgcatgaaagggataaggagaattgatggtggccactgttggtgaccatagttgcatgtagcctattaccatgacctactaggaaaacagtaacattcagaaagatgtgagttctggaatagcattgctaattttcaagatcatagaaccagttacctaaaaatcatatgaatggtgtttctcctctatatgttgattaaaagccctaaaacaccaaatttcttggagtaaaccaatttgtgattaattctgttgttacagttatgctttactatttatgtagcaatttttgtaattttgagtgtgataaacattttctgataagtggcagatgacaattttgggatcttgaatttttatgatctatatatttattgtttaaccgtttttgctgccttaagatacttaattatgtttaaatatggtttgtcccactaactttgtgtaactacagtagttatttacaggtttttttttttataatttactctttgattaattcctaagttttattcaggtggaattaatttttaagattcctttaaaaatatctgatttagttataaattatctcagcaaaatcatgaattgcatttgcttttaccacttcttatcaatattgatagagtttggctgtgtcgccacaaaaatctcatctttaattgtagttcccataatccccacgtgtggtggaagggaccaggtggagataatagaatcatgggggcggtttctcccatcctttcctccttatagtaagttctgaggagatctggtggttttacaatggacttctcccttttgcactgcacttctccttgcatctaccatatgaagaaggacatgtttgcttccccttctgccatgattatatgtttcctaaggcctccccagccctgcaaaaccgtgagtcaattaaacctctttccttacccagtctcaggccgttctttatagcagcatgagaatggactgatataaatatttaacaaatgttcagttttttttctatagaacactattttgaaatctgaatatatggctttcaatatgaatccaaatcatctgagcttgcttttattaattttaccttgatttattcattttctagacaatcaatgcatgcaaattttatttttaatatgttttattactttatttgtgatatggaattagaatagcaatcttagtgtttttaagatgtatatcttaaaaactttaagctgcatttttgaagttcatcacattaattcagatttcataatttaaaaaaataaaattcactattgctcaattgccttgcaatagacttcacataataaagacacttgacagaggaaattttgtgtcatcacttattaaactcaaagttatataaaaaatgttcttctacatcactaccatactcagaatattctcatggcaataaattcagctctgttctgttgatagaaatttgtatgacaccagtgaatgtggagtcatggttccagaacagggatttttgatatgttttctgttggtagatgttattaattttagtgtttaaagcctagtcctctgatttaacatttcattctggcaactgtgttatttcacgagtggaaaaatatagtgcactttttttaaaatcatggtttttatatgcataagagtgtttgttctgattcacaatggaaactcaaaataacatttcaagtttccttatgtgcaaagactatttacaaatctaaactgaaaacagacaatctttcaatgtgttatcaaaatgtttatagtttctttttctggagatgccaaatgataattattgaataaaattctaatctgttgagcatttctgtaaataaaaagtgaataaaactatgatttgttgttttttataaatgttttataatgaatgataatacatttacatataatttaacaaattgtcctatcctgttctgtaaaataactggcctgaattacttttatagacttttgatacatagaaataatgtttttacattcttaggtgaattatatagaatattctgcaactagagttgtccaacctgttggtgatctattaatgggtcatgaaatcaactttgttggttaaacttggcattaccaaaaaggaatcaaattgactaaaatagatcagagtgaagaatagtagaatacataggtgtgcagtaaagagtagattttatttcatgaagattttgtttcacttttatacatctatgtgtggttggtcactgtaaaatatgcctctagctaagggtaatggtcaaatcaattggaaaggtacctgttgagaagtgtctctagttttttaataacaagattaaatttcattattgaactaagtctagtgtttctagctgtaatttgatcagccacagactgttttaaaatatactatcctgacttctccaaaatgcaatatatcaatgtagcaaaattccacttataccttatgaatatatgcaaataaaataaagattagctattattaattgggaaaagtgtgaaattttggtcttcaaagttctaagtaaatatttgcctcctgtattaaatgctttctttgatactaaaatgcctgggactcatgtattgatttacctcaaatttctcagtttattactcataaccatagaacagttgtctgtcatacttgaagtattttgacagaaaacttcccatgtgtaagagttaatgtgttgacttacacaacaggaagtgttacaacattaaaaaatagcaagtttctattacttgtatgttgtgacatgacaagttactttcagaatgaggtgaagtataatgtataaaaaatctatatagtaaaaatgcaaattccctcattctgaatgcaatttaaataattattgtggttaaaaatctgtagttgttaaccaaaggttaatctattaggttagtattgaagacggattttttattttttatttttcatttttatttttagtgctggggtacatgtgcaggatgtgcaggtttgttacataggttaacgtgtgccataatggtttgctgcacctatgaacccatcacctcaggtattaagctcagcatctattagctatttctcctaatactctatccttccccgacctcaccccgacacaacaggcccaagtgtgggttgttcctctccctgtgtccatgtgatctcattgttcatctcccacttataagtgagaacatgtggtgtttggttttctattcctgcattagtttgttgaggataatggcttccagcttcatccatgtccctgcaaaggacatgatctcattcttttttatggttgcatagtattccatggtatatatgtaccacattttctttatccattctatcattgatgggcatttgggttgattccttgtccttgctattgtgaatagtgctgcagtgaacatatgcatgcatgtatctttgtaatagaatgatttatattcctttgggtatgtatccaataatggaattgctgggtcagatagtatttctggtgctaggtccttgaggaattgccacattatcttccaaaatggttgaactaatttacactcccactaacagtgtaaaagcattcctatttctccaccacctcaccagcatctgttgtttcttggctttttaataatggccattctgactggtgtgagatggtgtctcattgtggtttttatttgtatttctctaatgatcagtgatgttgagcttttttcatatgtttcgtggttgcatgaatgtcacttgagatgtgtctgtgtccgttgcccactttttaatggttttttttttttttttttgtaaatttgtttgagttccttgtagattctggatattaggcctttgttgcataaatagatttcaaagattttctcctactctgttagttgtctgttcactctgatgatagtttctttggctgtgcagaagctctttagtttaattagattttttaaattcttagtaattgatcagtcatataattgtaccttggtttagtatactgctgaaacaccaaaggtatgattctctcttcaagagactaacattttaattgaggagataaaattaaaactcatgcaatatgtgagctcttgaaatcaacaatgactgatgtttatatttataactcttatatcttcagtagtttctttaacaaaacctcagtattgttgaatgaatggattattgaatgaattgatttacatgatgtaggaaaactgtggtaatgtctaaaatttaacatgtagttagagaatgaaggagctaatatgatctcaagttgttagaaaaagtattaaaggcagtcagattagatctgaatgctaatgactagtctgatgtgttctagattagggggaactgcataagcaaaagtgctgtcatgagctagatgtgcttgtaaagcctgccctaatctgcctcttttctttttctagagaaagataatctttttcatagtccttgttggtgtacacatattaacagccccctaaagttgtctgtaccctaatcctcagaacctgtgaatgccaccttacatacaaaaggtaatttgaagatctgattaaggatatggacgttgagatgggtaaattatcctggactacacaggtgggctcagatgaatcacatgagtccttaatgtagataatctttccagttgtggccagaaagagatactatgacagagggaagaacaattccaactgtgagagatacccaacctgccgttactggctttctagatgcaggaaagggccctgaggcaaggaatggtgggtggcatctaaaagctgggacaggccctcagctgacagccaggaaggagacagggacctcagtgctacacccagatggaagtgaatcctaccagtaacctgatgattaaggaaagtggtgcttctctagagccacccgaaaggaacacagccatgtgaaactgattttagcctgatgaaaccaatgtcagactgtgatatacagaactgtaaaataaaaaacttggattgtttaaaacactaaatttgtggttaatttgcaatagcagcatataccccatcacagtgatggttcaggcagctgataactctgtgattggtttgatagtaccatcctttacctaatcgttcctgaatctgtcactcaccaccttctatacacaaacctataattttttatcaagatgagatattgcaatatttgagtagttccaattctcatattcatccctttctttcctttcctgtacccacagtcctaatcctgggctcatcacatcttgacttgctaagtacatgagcctccttttaaataaattttttaaaactccttttgaacttgttgcttcccaagtcaagaactttaaatgattccttgacgttaatagcctcctctgtggtatagctttcaaggtactctgcagcctggtttcaacttacatttattatgtctcatatctcagtatatttctacagaaatcatcttacctagccaacttggctccttcagaattccccaaatatacctcttggttttttgccagtgtgatttttttttttgcctgtctcattcctctcaccttcaatgtatttacttcctggcatactttgcgaattcaaaccctagttctcttttgtttagtgtctttcaaattagcaaaagttttgcccctggaatagattatgctcctattatcttaataacaatgaaaaggaaacttcagagctccaagagaatgagaccaatgaaatcatgtttcctttcttccctatgaaatgtaatgtcagatagtatttcgatttttccaaaatcattttcctgtttagtcctgaaggcaggaatctgcaaatatcaaactatcctagacttcacagctgggtcagacagatcaggctagccctctggcaaggggtgttttgaccctttgtttttcattacttttcctagacagagattgagagttcctggtgaaatcaaattacaacctcagtaggtaaatgccagtcctttaaattgatgtgagaatcacgcctgtaatcccagcactttgggaggccgaggcgggcggatcacgaggtcaggagatcgagaccatccgggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaattgatgtgagaaacaaagggatacctatctccctgatgagtattcagggacttatactgagagagcgtataaacatgaggacttaagcagcggatgtgctcattattcactcccagagcagatctgcaggaatcttaacaggaaagggcagagtgatcttgcttggcagtcttgctaaaggaaaatgaccaaaatctattcttttcctctttcaaataagaaagaaaaattatttcatagtgatctatgagttttaggatgcctttattttcctgagaatccctcaaaatatccacttcaaatattaaacattttgatcccgattgtaaactccagaagcctctaacacctgaagcatgcattgatgaacttaaccgtgaattggctgatgagactcatgatctttcattcttatttaaattatatattgtgttttaattattacctccttttgttacatttccttaagcaaattataagttctttgatggtaggaccttatccttattttttgctgtattcataacggtgcacacagaactatcactcaaataatgtttactaaatatttacctcaagtcaagcacgcttctgcctatgttacgccatgtcttgcctatgttaagttctttttctcctgcctggaataccatttaaaactatctgctaccaagaaagccacaccctttcagcagacccagagaactacagccaaaaaaacaaactgtttattagttgaatattttacagacgtctctgcgctggatccaataccttataaaatccttgattggtctaaaatagtttaaagtttgggcacaagaattgagaggtgtttttttgttgttgttgtttttaaagcagagtttatataaatcctatcactgcaattgaaatcaaagcagagagaattccaagaactttgactatgctagattcagtatcaggcagtctaggctaccctatcatttgttttattttactgaatgcttgctaaaatgactatcagtgttaaaacattaaacttgctccacttgttcaggtcattaaagaataggtaataaacaatatggttgatatgaagaatagaggaaaactactttgaatatccctgagaataaaataaacaatttgtgatggctgggagctgtacagctaatcctatatgacatgaagctatcagaaataggttacatcttttttagcaaatggcttcacaaggttgagactcaacgagacagtcagacacagtgagaggttcttgaaacagtttcagtcataaaccagtgacaacattccgtatatttataggggccatttagagggccattagctgacttctgcccttttcagtcatacctgcatacttgaaatcacctccatgagagacttcacttttaaaactcattggcaatttaatatgtaatatgtaggttcaattctagtgttttcaggaaatagagtaagctcagtctaaagtcaaatcaagtcaaatcacataataaatagtaatattaataagaaagagtaataattgcattattgtgtagtttattgtattacttggaatttctgtttcaccaaaacacagaaatacctcttttacaaattagttaagatacgcggaactacattatagtatagctaccattttcaatattaattggaggtacaaatggagacagaggtcattttagggttactcctttctactgagagtgattgttttatctagtccattcaagcaatttctataacaaagtattaatagctgccatgtgctgtagccttctgaagtaagtgagaaaactgcatgggtcttttggtatcccgtatttaataaatgttcattctttggaatataagttcccataaggcaagggaagcatatcatatatgagaaagaattttaaaagcttgaatgttatgcgataatctactagcatatacagtcaaattaagggtatttttaaaagtcactataacatgcccactactaaatatgatagatctagaagataaaagagtactgagtagtaagtactgagcataaatggtgaaatcacattgcatttacagatgtaataaacttctagtgttgcttcttttcaggtaatgagcttgtaattcattatttttctaaatattttaggtctttcaagagcaatacctcttattttacactattgaaattatataattaatatgggaaagaatgactccactgcataatgatactagaattatagtggtgaatatagattaaattaccaactaattaatttgaaatttatggactggtggccactagtgccatggcacactgaatgctttagtaagcaattgcattattcaacagaagtcttagtgggagtgattgacaaatgtgggatgcaggtctcctattatgaatacagattatgaatcagaggtagaatttttatcttgtgaatgattatatcttgtgaaatatattatttgttgtctgatttaaacctactttgttttggctctctgttctttcagtttcaattccattatctattttaagttctttaggaattataaaccacatgctgtcaatgacaggaaaacactgcccattaagtttaatgaatcattcagactgattttcaatggctgagaaatatcaaagtggcttcagtaatgtatgtaatgtgtagaaaatctaagtataattcttaagaaagatcatcaactctgagtgtttgtgatataatactgtatgtatggttaatattttttctgtttttataaatatttcctaggagaaataggttctaatattgtggatcataggaaaaaaatccaaatatattattagaaaatgtatttaaaactaatactatagaagtttagttgaaactcattatttgattattaatattttaaaattatagtagaaatgtttatctttaacatttccaaaattttaaagagtaaattagggtaaagaactagtttctgattgtataattttactgttggaatgcctcaattatagtagacatctccttattgttcataataacactgctgtggacaaaagccacaagcagaatgttggcatcatgtgagcagtactgcatgaaggtaggattgagtgctcaccagcaacggattaagtcattacagcccagttcttaacaaatccaaagaacaaattgtcttttacacctgcacataccaggaccacctctaagatgtgcattgtgatcaatgacaggaaagtaaaaacaagtcactctgtgggaaggaagaaggagcacaaataatggtcaagggacgtggtgatggtggaacgcattataagatacaagcttcaaaggtgctccttgaaaggtttttgataacacacacaagacaaaggcaaatatagattagaacagagtttaagatgcatttgtaaacaaagatcttcaaagtaattattcaggaaaaagggggagaatactgacagaagagctgtaaggagattcttatgtccaaaggagtgcaacatgaggaaacttctggcttgaggtttcgattaaccagtgacatgaaattcgtgtgtgtgtgtgtgtgtgtgtgtgtgtgtatgtatgtataattttcacatatctttctataaaacattattacacagtgtactgtcctaaggatgacactgtgacactataatatttatactgcatgttttattccacactttttattcctactttctaatattaaaaatgaggaagtgaaataaatttcttacacatttcttaaaattttgccaataggtaagtaaatgttaaaaatttaaaattaattttgttctgagtctaacaagttatagtgaatagatgaacttagtggtagattaagggatctcatgggatattccagtgtcagcataaatcattagaagtcagaggagtcaaatggaatcccatgtgcaataacatctaaaagacatgaattcaggaactaaaattatgaaattcttaaaacgtagagaatatttgtaatctgcaaattatggatttttttaaggacaagaaggtgtaaaaatggcaaatagaactttatcaaattaaaaatatttgctctttacaagataccaccaagaaaataaaaacaagctagagtgaaatgaaacattttcaaaatgtgtatctgataacagacatttaaaaaaaaaacaggtgaagaggaattgccactaaaatacaaaaagacaacacaatttaaaaatgggaaaaatatttgaatagacctaacaaaaatatacaaatggcaaacaagcacataaagtatactcaacatcattaggcattaggaaatacacatattaaattcacaatgagttacaactacaaacccatgaaaattgctaaaattgaataccaagtataggtgagtatgtggggaaactaggaccctcatgcagtattggggatagtttgcatctagtagccactttagaaaatagttgtgtgtgtgtgtgtgtgtgtgtgttttaacattctatccagcagttacatttctagtatctaggtaagataaatgaaaacacatgtgcacacaagcatcttataggtaaattgaataaacctaaatgaccatcatcttgtgaatgggtgaataaatatggtgtatccatatgatggactactacccagcagtaaatggaatgaatcactgacacatgcgacaacatgaatgatctcaaaagtattatgccaaacagaaggtgctagacacaaaagactacatagtacactattccacttacatggaagttttagaaaaggcaaagctatagggacagaaagcagatctgtgctgggaggaggagtggggaaaggctgcaaatgggcataatgcaatttggggagttatgaaataattttaaaattgcattgtgataattattgcacaactatataatggtactaaaattgaattgtgtgcttaaaatagatgaattttctggtagtaaattaccttagtagagctttaaacaattattaggctaccaccataatgagattctaagattattttctgtttttagtaggaaaagtgtgtacatgtttttttggttctttgttttgttttatttttgtttttttggagatggagtttcactattgttgcccaggctgtagtgcaatggcttgatctcagctcactgcaacctccacctcccaggttcaagcgattctcctgcctcagcctcctgagtagctgggaaaacaggcgcccaccactatgcccagctaattttttgtatttttagtagagatggggtttcatcatgttggccaggctggtctcgaactcctgacctcaggtgatccacccacctgagtctcccaaagtgctgggattacaggcgtaagccaccgcacctggccaagtgtgtacatgtttaattgaaagagagacattgaaaggaaaagcatccatctggagagaaaactagcaggctgctgctacctgcaagatttcagaaagtggcattttttaacttggtaaacttactgtgatggaatatctggctgagaaacttgactttgtcagcaggatgacaaatatcattgtcacatgggccaggatactagcatacatgtaataattttagtactgataacagaactatatagcaagtaaaatggcaatttcatttatcagtcataatgaaataccttggtatattttaggtaatagcaatggcaaagtcaagaatgtcagcctgtatgaatggctcataaaatacataaaaattagcactttgcttgataagttcagactcacaactagggcagttaattagaaaaagttgacattttctggaaccaggatacaataggatggtttcttcattccacagcaaggatagtgtttttccatgtctaaccatccccctcagagaaattatataaacatagacatagatacatgtatagagatgtagagatgtagacatagtgatatacatttgctagattgattccttttattctagcaattattcagcctacttagatggatttgcatttgtcagcactgaaaatttatgttgatcataacgttttatagtcagaggacaagtttactgctttttctattagttatctattactacacaatcaaagctcagcacttgaaaacaccaaccacttattgtcttacagtttctatagatcagacatccagagtctaagtgcttctaactcagggcctcttacaaggctgcaattaaatcatctcagggctctagtgggagagcatcaactgccaagctcacccatgtgtggctgttggcaggcctcaggtcctctctggctttgggccaggtactcgccacatgggcctctccgtagggaagctcactacatggcagctggtttccctcagagcaagtaaccagagaacaagtgaaggcacttagatggaagccacagtctttttgtaagttaaactcagaagtaaactgttacccctgccacatacttttcaacagagaagggtcattaaatccccattcagggatataggattacacaaggacatgatacaaggaggtggagtcatcataccatctcagccatcttcaaggatgcgtacatgtctgtctttatatgttttgggagaggcttcattttagctcttagtattacttgacatgtcatccctggtgaaaatacgtagttcctacaaagaaagtctgaattaaatatagatgtaagactccattgttaacaattgaagggcaagagcctttttattaaaaatcaggcaatataatgataaaggcaggaggaaatatattttgtctcaaggggaggaatgagaagtacagggttgcttgaatagcattaagaatcatgctcccgtgtaaattgttactgtctgttttctcacttagcatcaatctagatggagacagaagaaaactagaaaccatataaaacatgtattttatgcctcgcttgtccactgcgttcttcttttcttttttctcattttaaaactcatacccacttttaaattaaattggcaaaaaacacatttttttcattaaccttttgtgatgcccccaaactctggggtcatgattatatgcctagaataacattttacttgaatgtaaaagtgaaatgtgaactttaaaaaaccatagtacttaaatgtggtagcgctggtggtggtgatgcatatgtgtgcctcagtttaggaagctattgataaatgttacaagtctagcaaaatgcctttactttcatcccttaatatgtttctaatgtatttgatttactattatctttgttcttcttttccatttaatgacttttattaaacacaataatcaagagataaaatacactaatattcgctctggttaacttcaggaagctgagctgtgtattctgagtatagagtactcagcataatcagtacacagtgccctgaaactaagttattcattcttaggtaatgtacctaagaagaaagaataatgctttcatctttaaagtaaaagtagaagcacaaatttttgcgcctgagtcttttttgggcaataaagcaaatcaaaaacatttaaataaataccagaggtgacattaataaaactgttgctgacaccataagagactgctcctttggtgttggcatttttgtgtaattcaggaattgtatctctataagtcatgaaaatctaattcaaataagcacaggcaaaattgttgttttattgaaagtctcctatattacgaagagaagattaaaaactaaagctgtataaatgtctagaactctgccaaaactctgtcatctcttcttatggtagtttttttgccatatggcatctgaaagagacagtcttcaaagatctgtaacttagagctctaccatcagagtgaaaaaatcccagagttatattctgatttgtcaggtttgggtcacatttctactctggaaacaatcagctgaggccagagagtcaagatactgtgactgaccatatttgcatctggtgttcctcttgtaccaatcaactacagccagcatgtagtgcaatacacaaacatcaaagttacaaatcatcttcttttggtctctaagcttaatatattttccttattttttagactttttgatagagaattctattacaagtataacaaacacagactcagttctctgtgcttgcattagagccattgtcatctctaaacctctaatgtttttgaaatcttagcttgctattttttgagtattttgtgcatgtatattaaatgtaatctaacttgttggtatatttcataactgcactgagaagtaggaattatacatgaatttgctgccaatattaaattcggaattcatattacaagcaacttacatttgtaaaatcagtactaacttttttgttactgcatttttaaattgacagataaaattatgtattatgtacagcatgatgttttgaaatatatatatatatatatattatgaaatggctaaatctagctaatgcacatagttaccactttcatggtgagaacccaacatccactgatcatttttcaagacagtatattgttattatctatagtcataattttctgcaatagatccattgaatttattctttctatcaaatcgaaattcaatattctttgaccatcatcttctcaatatgccagcctgcccaacgcctggtaaccaacatgctactttctactcggtgagatcaactctattagactcagttgaatatttatttcttttacaaggatagcctttggaaagatgaaatagccaatctagtcagtatttaaaattttcttagcaagatctttacaaatgtcatgcttgaaatgagttaaccagaagtcagtagccttgagacattttttgtttttatattctataatgcaaaaattaaatttactttggcaaactaatttttaaaaaaaatatatcattcatctaaccagtctgcactcggtggcatataaaacatcacattgcttttttattatgcttttattcttaaaacataacatgttaactgtacttttgccatctatacatattattgatgtatgtattataacctctgaagtcaaactccattggtaatacattgttttattttttgtttgtttcttaataatctatggtgttttgaaaagaagagctttggagactgactgaatctgagctctgacacttattagctaatacgaatgtggtcatgattctactgtttttgaatcctaaattatcaaatactgaaatgtgttattgggaaggaaaagtgctctagcatctgtaaggcacctttatggacacctttatggaacctaatgtggctcagcaaatgggatttccctcccctgtctttactgaacctcacttccagtaatctttattattttgcattttacaaaacattttcttctaattcctgctttttgaaccatataacatcttcctgcggtaagaaagaaagctgttatctccattttgcaattaatcaaactgagaagcaaagttgaaaataggagacataaagtatacttctggaaagtttattgagaggcatcagaactaggcctgctatagtcatcctattgactcagtccttgtgtccttataagcagataacagtgagatgaaaaggaatttaagaagaatccctgagaacaaggaggagatgagtgctaaatgaggtttgatatttgacatttaagttggactaaatttggaattgctctagtcattcttcagggacaggaaagagttgtattgtgactgaagaataaaacaaaactaatatttgttaatctagaaaagtttagacttttcaatgaaacatttacaatgactaggttacaattttatgtgaaaacatattgtcatcattctgtcttcatgtcagggataatcaaaaaataaacagataattttttccctaagaaaagcaatgctgatgtaaggtgaagaaagcacgcagctgccattgcacaaggtttgatgctcatctctgtatatttttatatctctactgtgtctttgccttatacctttaatattaatgtagcatttactgtattagtctgttctcatgctgataataatgacatacctgaaactgggtaatttatgaaagaaagaggtttaatggtcttacagttccacatggcttgggaggcctcacagtcatggtggtaggcaaaggagaagcaaaggcacattgtggcaggcaacaggccttgtgcaggggagctcccatttataaaaccatcagatcttgtgagacttattcactaccatgagaacagtatgggggaaactgcccccatgattgaattatctccacctggtgcttcacacatggggcttattataattaaaggtgagatttgggtggggacacagccaaaccatatcattctgcccccagcccctcccaaatcttatatcctcacatttcaaaaccaatcatgccttcccaacagtcccccaaagtcttaactcatttcagcattaactcaaaagtccacagtccaaagtcacatctgagacaaggcaagtcccttctgcctatgagcctgtaaaattaaaaacaagttagttacttcctagattcagtgggggtacaggcattggataaatacacctattttaaatgggagaaattggccacaacacagggattacaggcctcatgccaagtcagaaatccagcagggcaatcaaatcttaaagatccaaaatgatctcctttgactgcatgtctcacatctagggcatgctgatgcaagaggtgcattcccacagcattgggcagctccacccctgtggccttgcaggatacagcctcgctcctggctgctttcatgggctggcattgagtgtctgtggcttttccaggtgcacagtgcaagctgccagtggatttacaattctggggtctggaggatggtggccatcttctcacagctccactaggcagtgccccagagggcaccctgttggagggctccaaccccacattccctttcacacggccctagcagaggttctccatgaagaccctgcccctgcagcaaacttctgcctagacatacaggagtttccatacatcctctgaaatctaggcagaggttcccaaacatcaattattgacttctgtgcacctgcaggctcaacaccatgtgtaaaccagggcttggggcttgcaccctctgagcaatggcctgagctgtacatcggccccttttagccacagctagagctgaagagtctggggtacagggtgccatgtcccaaagctgcatcaagtggggtccctgggcctggcccaataaaccatttttcctcctaggcctccaggcctgtgatgggaggagctgccatgaaggtctgtggagacatttcccccattatcttggtgcttaacatttggttcctcgttaattatgcaaatttctgcagctggcttgaatttctccctagaaaatgggtttttcctttctattgcattgtcaggtgcccagtttccaaaattccatgccttgctttctcttgaaggctttgccatgtagaaatttcttctaccagataccctaaatcgtctctctcaagttcaaagttccacaaacctctagggcaggggcaaaatgctgccagtccctttgcatagcaagagtggcttttacttgtcagtgtcagttcctaacaaattgttcatctccacctgagaccacctcaacctggacttcattgtccatatcactatcagcattttggtcaaagccattcaacaagtctctaggaagttacaaactttcccacatcttcctgtcctcttctgagccctccaagtggtttcaacctctgcctgttacccagttccaaagttatttccatgttttcaggtatctttatagtagcacctcactcctggtaccaatttactgtattagtctgtcctcaggctgttaataaagacacagacaagactgggtaatttataaaggaaagaggtttaatggactcacagtcccacatggctggggatggtggaaggcaaaggagaagcaaaagcatggcttacatggcagcaggcaagagagcatgtgcaggggaactccatttataaaaccgtcagatgtcatgagaacttactaccacaagaacagtatgggggaaactgtccccatgactcaattaacatcacctggcaacacccttgacatgtagggattattacaattcaaggtgagatttgggtggggacacagccgaaccatatcacttactatgtttgggatgttcctccaagttctgtggtttctgcagccaacaagataggtaagtttgatgtccatattaaagagtttttattcaaaattggacagatatatttatgagattcagaaagcaggaaatttcaggtagaggtaagtgttatgaaagaaaataaaaatgaagtgtattaatcttctattgctattactggctcaaagtttctaatagaaagtttctagtaaaagttctaatattagaacaaattcattatcttacatttctggagtccagaagtctaaagtcaaggtgttagtagagctatgttatttgtggaggctttggaggagcatccactttcttgctttttttcagattctagaggccctcccctcaattttttggtttatagctttttcctagtatcactacaacctcttatttctgtcaccatatctttttaccactgatttttaccttcttgcctccctcttacagggactcttgtgcttatacttgtggcccactcagctaatccaggataatttcctacctcattctcataagaatcctaaatctcatttgcagtgtatatttcactaaacaagataacatatttacaggttcttggggtgaggatgtggatatcttagttgggcagagtttttcagcctactgagtgaatatagataacagaataatcttgagtggacagggcattgtcagattggatgttcatggttggtttatttgaagtagtaacagttcagctgaggtagaaatgctgaaagaactgctataatggctttctctgaaaagaattatcagtacctatgagatgatacagtctactgattccatgtgactataccattaaaatcatgtctcaattatgaatatacagtggtatatttcaatttgcccttgaaagcttttgacagcaaaatacttacattaaatttcagcaacttgtgatatctttaaagtatctagatgagaactctagaagtttctcataggttagaaaacaatataccaaaatttctacatggaaaaatattaatttacagatatttttaaaatttcattgaaagggaagatataatatatccacctactttcctaaaacgactaaataaacagtatgttaccaatttttattttatttacaaagtttaaacaaaattagtttatatttctaatttagggagttgaaaaatttcagacagaggtattattagaaacttagtaatatatttttatttctggatttaacaccacacacagagtacatcaccataccataataaaggtcaacaaaaaactcaaagaccctgactttatctttgcagcaattattttgccttaagtacatcatagcttagctttgaattcatagtacccaacaaagtacatatatgtctctacatatacatatataacacatatataaatatatataatatacatatatatgtatacatattttaactggaagatggttaaactcttcccacccattaatgattagtccgtgtgaaaatacatttttgggtaggagataatattttttattattccatgaagtaaaaatatgaagagtattcaaactgactctcttgcttatttattttccacatttaaaactctgtgatgttgtgagcctgtgttttcacacttcagtttgcatagggaggaggtgcattatcaccaggatagatgcttgtgtgaatgagcagtccaagctgatagctatgcagcactttcattagcactggaaagtggtgttagcatgactatacagaggtttttctttggcttgactcctagcttgctttttgattttgattctggattgaagactcaatttgtggtgggacatctaagtggagcaatttcctaaaatcacttgggatactggaatatctctggatgcctaaatatctctgggtaattttagatacatgaacaaacatgaggttatttttaatgttgattttattatatcagttttgctaagtatcatcacttggaaggaaaattgagatggagtattttatatctcctcacttatcaacactaagatgctttgttcgaattttttttctcaaaatggataaaagatgtaaggttttacaacatatgaatgaaagaatttaatgctggaagctaaatataactacacagagtgtcctctcttgagcatatggcactgttcattcacctgactcttgccctaccctcctttccagaattatcttcttctaattccagtatgtgaattattaaacatgtttgggaaaactcagcagaagctagtcttccccagatatccatccccaaacttttctttttccttctttaatctactcacctgaaagtaataagaaaaattgtatgtgtatgtgtgtgtgcacgcatgtatatatgtaatctccaagtgtatgtgtgtgtgcacccatgtatatatgtaatctctaagtgtatgtgtgtgtgtgtatatatatatttacacacacatacacatatatacacatgcacacatactctttcccttcacggccaatgactccccatttcattttgaacttatgcctgaattctaccatgatctaatccctgcctgcttttcacacttcatgttgatgctactcttctatttgtactctatgatttagccattaatgtgccctttcagttatctgagcatgtgaagtttgctgctgcctaaagaaatagtacatgatagtctctgtggaaatctcttgcccctcctctgtatttgcctgtcctgttgtccatgagtctttgccttaagatgtacaagctcaaagagacttttctgtcctgggaattttctctaagtgacttccttcttttattctctatcactataggtattatctgacatatatttacatgtagcgttgaaaaattataattttgtgtatgtatttgtttagttaattatagtccctctttctcactagattgtaagttccaccaggtcaggggtccttattacttttgttctccagtatttatccagtgcttagtggtatggctggcacatagtaattgctaaaggatatttggatgaatttttgagtaaataaaacaatatttctatttttatttctctctgttctatattgtcattcctttcaaagtgtgaaccttctgaactactgggagtaaaaaggcaggaggaggtagggatgaggggtggttcataattttaaggctctttctttagctgcacaaagacccagccaaaattttgcaaggtcctgtttattcatttgttctgcccttttgttgaggttttgggattattcagaggagaatgctatgttgataattgaggagcagatatctaagcaagaattaaaacgtgtgtacatatatatgtgtgtatatatatgtatctatatatgtgtatgcgtgtgtgtgtgtgtgtgtgtgtgtgtgtgtgtatacatatatataatttagatctataaaatcagttgagtatatatgtataggtcacccagtctttttgggctagaccaaaccaaatgttggaacttgacaaaatagaagagcgcgttcaactaagtggattgtctgtatctttcctggttggaatacaagtaggacactgctcctccctgttttaatggcattatgataagataatccacatggaaatatagtaaacaataattagaataattataataattagaaatgtagtcattccagctagctcctttttaagaaaagaacaaagtataatgaaggaatttgaaaagcatttgtaccataaagaataacataatgatatgtgaaacttaagtgatgtataagagttgttatgtataaatgttgagttatgtataatgttgagttatgtataaaagaattatgtgtaaaagagttaacctgagtttgctattgcataggcttcctgggcattgctgacctgttgtctttcttttgctttagtcaagtcattgtgggcaaaaatcatatgtttgcacatccatggagtctttctgctctgtttctcagcatcactacctagaaagagccatcaaaggaaaaaaggcaaaagctctctttcacattaaaagatagtcccatgaggagaaaatgatttcccttgttccctctttcttcctgtgatgctggttttaggctataatcctggagaggtagcatccatctggggaccgtcatgtaattaacatggggaagaaatcccaacatgatgctgtaattaagtaaaagagactaggtccttatttagtcactgaaggaatcccagaaccaaacaccattttagtgatcaaaaacattcctatggttctggccacatttagttgggttttctattatttgcacccaaaataatcttttacagattttttgcctttaatatcacccaatagattggcttacccaagagaaattgcaggaggggcagtcagggtgggaaggtagcatatctaagggattcagaattttctgggaggtggagacttggaatatatttatcacataattctcacagtcagtgaaatggctgattcccagaagtgaatacatatcctagtggaattataaaaggtattggttatatgtattaaatggaaccttacattagaccagtaaaaaaaaatgaaagctattgtagaacagtaaattaaggaaataaattaaaataggatactgactataatacaaactataattttgttgtaaagactaaagaaaagatagagcaacaaatcaaataggcggacatagttgaaatagttgacaaagtagtctttagagaattattcctgtattatgataaactctggacaaagaaaatattgcgatgagatgcggtctcattcaatgacagacatactgcatttccttaccccagattacaaggtgtgaaaatatttagtaacactgttttctttcaattttccattatatagaaggttagttattttcagaaagtcaagcagtaatgcagaaaattgctcggtttgaaagactgttttttagcttcaaaagtcatctgtagttcagcattagagaaatgtatgatgttaggctatataaaattcatttttattctcataatagtgacattggtgttttgttaaacaaactagcacacttctagctaagtaatgaaatctttagattctgaaataagtcacttagaaacacataaggaccagttatgtagctttcaattttttcttgtttacaaatgttttcaccacttcataacagggttgttcaaggaaagagcagttttcactggaaaggattcatagaccattggcagtgctttaaccttatcacagtcaggctgggcatctcctagagatttttggattaaaggaactcatgaagtcattaattggaaagagacacaggttaaaattcatttggcagtgatacttcatatactcagtaatagcagaagatggttagggccaagctctttctaactagtattttttccattatcttaaaatatgtactttgaattatattaattacagtgaaggatataataactaggaaacctaaaattagtgtcatttctaatgctgaaagcatattaaacatgaggtctgcttggatgtctatttaaactacaatattcaagtgaatttctttctgtggaaaaaatgtgaaatgaaaaggaggggtgagttgaagagaggacaagaagggagaaatgagaggagagaattatgattgtatatgatgttggaaggccaaggcctaataagttcatttttttcattcaagcacattaatgcagtcctcatgagattatggatgctgcgctaatgccaaacacggctccgtgtcatcactcttataagctagtagctctaacaaaacctgtaatacttaaaataactataaagatgcatttcagtgctacaatcccaaaatattcttactagagttcaaagatctaaaaagtcatttaagtatatattctagagtatagaaaatatattttgacatttgagagttatcactcaagtaaaaataagtaatatatagagggctaattattagtgataattgttagtaagatatgcacatcttccaattttttaagatactaagcctaaggacaaacatattaatgggagaagaataattttaaaattatatagtgtgatggatggttataaatgctatggaacatggaagggggatcaggagtacagggatggtggagcgggggcattatcgttctaaataaggttgtgacttagccaataacatttgataaaggtttggaggaggtgagagaagagttatagggatatcttgggaagaagatacttcgctcaaggaatagcaagtgtaaaggttctggggtaaaagcatgcctaacatgttggaggaatagaaaggaggttggtgtaactaatgaggagtaagcaagggagaacagccaaaggaagtgaggtcagactgaacaatacagaaaattgtagtcagtagtgaggactttgccttttactaagtgagagtggaagtcattggaggattttgagtagaggaataacatgatttgatttatagtttagaaggacctctgggtgttttgttgatggacgccttagggagatcactgaggaggctattatagtaagaaacgtgagaaattttggtggtttagatcacccagatcacagtgacagcagagggtggtgacaaatgatcagattgtagatacacattgacagtttaactggtggggtttgctgatgattgagtttatggtatgagagaaagagtgaagccaaggatgacttgaatgttttttttgagacctcgtgatctgcccgcctcggcctcccaaagtgctgggattacaggcatgagccactgcgcctggccgaatgtttttaatttacacaactgaaagatgcatcagttggtacagctatgtctttttctctggtcatgtttggtttgtgcaagcggaaataagaatatggtgagagttagatgtaaccaagattgatcttttattcatgtgggtacaatgaggcaagagaatgttagggagtggagtatatatgcaaagagctatcatttttgttaccgaactgaacttgggtccatttgtctggtgcagcaaagctaaacattcacatgaggattgcagcaagagaaagtgtgacatttattgcagagcacctcgcaaggagaatctgggagctcgtgcttaaaacccaaattcttggatggcttgtagataaggaggtttaaaggcaggaaggcagaggttataggtaaagtcataaatcaatacatggagactatatattggtatgatctagaaaggtgggacatcttgaagccagagcccacaggtcataagtggattaaaagattttctgatttgtgatttgttaaggaagcaaagctttttctaaaacgttgagattgacagaaaaaaatgttagttctggcctctgggtgtgacttcctcaggcccttcagaagaggccatttagagcaaagaatggcagtcagggttcagtcatcagatcctccttatctgaggtctacatgccaacaaatccatttggtgggggtcccggtttctggaaaacaacttagggatgtaaattaagatgttatctttagctttgatagaggaccaaacttcttgtgactctgactttcttggctactgttttaagctactgttactttcttgcttatcagtactttcttgctcatttacttctcaggaccagtgaggtgcctggaatttcctttggaggaactcaagattttattttattttatttccatgcttgggagtaggggtcagggagtaggcctctaagagggatctccattccatctcattatgataggctaaacaatttaatttggataataaaatggtgagggtgagttgaggatagtagtggatgagatatggaaactaagtgctcaggaaactactgggctaggttattaggaagatcattgaaatcgtcaaaatcacaaaaagttacagttgggctaggttattaggaagatcattgaaatcgtcaaaatcacaaaaagttacagttagtttgggaaagaatgaagtcatgatctgaaatcctcaaggaaggaggggaattgagtggcagttggtagaagaataaaatgaagaagggtcatgggtggcatcttgtttgttacatgagaatcgaaagaggagagtgtagggagaatagaaggaaatggtctggaagtggcaaacagaaacaacccattgtttcgaaggccatgggggaaaaaaaagccccttaatagggctataagaaaaccattatcctctgtggacacatgggagtaagatgatgatagaaatattcaaagagagtgtgtaaaataattttgctgataatttgatgattaattctagaagatccaatcgtttcaggaattggagaatggttagaaatggggtcatttgggggatgtagaaagatataaaatattttcattgaggttgagatataactttggagtctagggcactcttgatggctgaagaacaaacaatcctcatttgtcctggttctgtgattactgagatcaaagcatgttactatcaaatctcagtcatcacagagctgtgcaaagaaagaactataagtattctgaaataaatggaatgagattgatccagctctagtgaataaataaagcccacaggctgagtgtcaggctggaagtcaggccagtgtggaaacagagctgagcatcggaggacttatgcagaggaccaggagtattggttacagaggtggttctcctgtttttttttgttttgtttttgtttttgttttgttttttttctgtgccttagaaatgtctggttgctttcaaaaatcccgacacccaggccacatccgcaggaatcagcattttaaaaaattccctaagttgattccaatgggcagccaatttgagtgccactgtgctacagtatctcttaatcctatcatatgcaaatcattgaaaatatctgtcatgtcatcattgccgattttctcttcttcagttgtatctattcaaactgtgacagggcctcatttttcaatggcttagcttgttatttaagtagttgcagaacatcacattcatcaattacatgaaattctgtgtggaaagtttttaatgtcatgttgtatcttttttctgcatttttagttgcatcttttttctgcatttttagttgcatattattgttctattaaattgtattgcccagtttgaaataataattcactaacagatgttaaccccatgaatgagaagagatgcaagatattttcatcttacagtttctttgcttttctacctaaaaacctgtatgtagagatttgtaaaaggaaagatatattttttctctgtacattttatttgctttacaatatttatactttaagtaattagtataattagatatttaaaaattcttttttgctatcgtaaataatgcattaatgaatacaataatatataccgttttatgctgtagaagtacatattgcactgaacaaagttgaatggcaaagaagattttatttaaagctatcacaataggagagagaaagaccaaaatgtagtctgaacttgactgtgccaaaacaaagggtgggaagacttttaagcgctggggtgagctggagaccagaggccatcagtgtttgctaattagcttcacccaaaggaaaaataaatgttctcttattgttgtgacaggaggtagtttcataattaaagcaaggctccagcagaagttaggcttccagcatcccacaaaattgggaaacagcagcactatctcccttgatgtttacatttgaaagagatggctgccaggtccttgagaaagagattcctgggttgtaaaactggcaagaggcttttaaaaatatttacataagggcataggaaaaatttactattgcaagttttttaaagtaaagaaaaaaatgctgtaagaaaagggaaatcagggcctagtcagaaggaagcaggtacggagtttttccaagctgaggagaaccctaaggtctttttgatcaatgcttatttctcattatataagaggagttgtaaatggctaggtgagtgcaagaatgttttaaaaccagttgatttgtattgggaaattgcgttcagaatattttttttttatttatctcccactagtagagtatgaggatttccattttgctatgtgtgtgccaacatgagattgttaaagaaactctttccagattttatgtttatttggacaaatgtttaaatgaagaatgaaatatctcacttccaattaccagtgaaattaaactttaaaagatatattttttgttcttttgtaattctttttccaggacttgccattttgtaaagttttctacatttttttatactgtttatattatttttaaagacaactgtagtattattctgcttactggttcagaaacaagagaaaatctgtattgtaccaagagctaatgaaacctgggtatttgttttttccctggaaatttcacacttttgtttccactagattccttagttttgaataaaagcaactggggtaggagactgtctggtttgaggatgttttcttattttggcttcaggccaaaggaattgctatatcttagtttaataaaatattagacgctgataccactgttgcatagagacaatcactgcttgttggagaaaggaaagtaaatattttactgtatacatcaaatgataagcaaaactatcatgaaggaaagacaaaacttctttcatgtggcatcccagcctctctcccagcaacaaccacccacctacaacacagcacaccaaggtccatatcttccatgttttaattgttacattaaatattcttggttgtggcactttgatagtcacctcttgttttcatgcgcgtctgtgtgaagagaccaccaaacaggctttgtgtgagcaacatggctgtttatttcacctgggtgcaggcgggctgagtccgaaaatagagtcagcaaagggagataagggtggggccgttttataggatttgggtaggtaaaggaaaattacagtcaaagggggtttgttctctggcgggcaggagtggggggtcacaaggtgctcagtgggggtgctttttgagccaggatgagccaggaaaaggactttcacaaggtaatgtcatcagttaaggcaaggaccgcccatttacacttcttttgtggtggaatgtcatcagttaaggtggggcagggcatattcacttcttttgtgattcttcagttacttcaggccatctgggcgtatacctgcaagtcacaggggatgccatggcttggcttgggctcagaggcctgacacttgtttacatactttggcctttttaagtccccctatctttatatgttcattaaattctgaaagcttcagtgtttctcagtaacaaccataaatcattggagaaaagtagtatattgaaattactgtaatacttttgatatgtataatacttttgatatctttcagatctctaatacttttgatatctttctataatacttttgatatctttcagatctcttttccatatctattacttttatctcttttcaagtaatgaattgattgcgtattctaaaataaacactattctatactgttgaaatactgaaatgaaaccctacaagctcattgtaagggaacaagcttaaaagtatgtaatttcagtgaagtatattggaacataggcttcataaaaggtataaaaagaagtaagggaaaagaggacggtgagactaaagtttactgagtgatttctaactgccaagccctgagagaaatccagtcttatttaaaaaagaagcactattggctgaaagacttgtgagaaacactgttttgtttttagttttgcccacttagaatttgccataggatctggcacataatgcttagtaaaaaggtacagaagttgggaaagctagtgacatttgatctagttttaaaagatgtgtagaataaatgggcatttagaaaatcttaaaaattctttgtacaatatatgttgtcaataattttatggttatcaaaaatatcagttgaattatattttctctaggaaatattaatggtcaaaagtttaacttttaaaacattgcttaaaaacttaagccaacatattaatgactggtgagtaccatgactttattcctgatgagaataattaaagctagttaaatattatgtatattgattataaaaatgtgcttactatagatataattgtcatccagtttcaagagagcttattgtttgaatgggaggtcttgtattttttaaaaaagactgttttgatcttgaattataaccaataaaatggcattacgttcatgcagagcctcaatgaagataattaagaataaatagtggtttctgataaactgttagtgaagagaagatatctcacatttcccattgttcaaatttaagaagctaaataataaaaaataatatattcatatatataatctaaatatacaaagattatatatattatataatacatgcattaggaatatatattagctatatatggaatctatatgtggaacatacatatatatgtactactcagaaaaataatgttacaggttgttttggtataaaaagtcaggcttgctgaaacaagaaaaatagataactgaattttggatataataaaatgtggagaaacaaataagaagaagaaggtgaagcagtgagaaaagtttcaatgcttggagaatagtttgtgaatcttaacctttatcataaaaggtgaggaggtaggtatgtgcaatagatatccatttatattcttagcagtttgcaatctgatttaccccaaacctgcaaattccagttacaagtgcatactattctattctcctcatatttctgtgttgaaatttttgtctcacagattttctttaacctacgttagattattaacagagtacacacagatcacttataaaagggaggggagaaatgccaggggcgtgtgaaccagagcaactccctcttaaataggagtggggtaaaatgaggctgaaacctactgggctgcattcccagatggttaaggtattctaagtcacaggatgagataggaggtcaacacaaaatacaggtcataaagaccttgctggataaaacaagttgcagtaaagaagctggccaaaacccaccaaaaccaaactggcgacgagagtgaccgctggtcatcctcactgctacactctcaccagcgccatgacagtttacaaatgccatagcaatgtcagaaagttactttatatggtctaaaaaggggagacatgaataatcctccccttgtttagcatatcatcaataaataaccataaaaatgggcagccagcaaacctcagaactgctctgtctatggagtagccattcttttattcctttactttcttaataaacttgctttcactttgcactgcgtacttgccctgaattctttctcacatcacatttcttttggtctcaatctccagtgaaataactcctcacacatttcttactttccacatcatgcttccaccttctgaatataggtagtgctaatgaattccttttaaacattacttcagtattacatttgaatatgtaacattcaaattacataatatggtaatggaaaacgtggatggcagaaatgaaaaggaactactactaagtttaactacttttttaagtttaaaactcaaagcagagaataactaaataccaacagactgagcaataggggaaatttttcaaaataggaagaaaaagagagcgagagaaagaacaactccaattgttagtcctattaattaacgttcatatgactacaatggtagaaccatcgatcccttagatgttggttgcctagatgttcccaaatcctctggtcctgagggattattcttctttaataaataagtaaaattcatgttggtttccatcctaatgattatagaaaagccagcatttccctcacatcatctataggaacacttgggatctacatttctacacatcacctcttggcctgatttcacatggtcattgaaattctctcctgtggcctgttttctgtattctgtgttgatataaacacctacatattttttctttgatactccaaacccattgtgataacaaagctcttgaatttagcatagtctttctaaatcattttgagtagcacagcgtagaaaacactaacaaattgaatactagactattcttattagtagaatattattcttaacagtctttctttcattcacactgttggaatccctcacaggctgtcatttgtcatcaaacatccatgtcctcatctcctcaccttttaggataagtgttgggattcacaaacaacactctccaagcacgaaactttccttactacttcttcttcctcttgtttctccacattttcttatgtatgaaattcagttttctatttttcttcttgcagcagtccttttacttgtgataccaaaacaacctgtaacattatttttctgagtaatcatccaccctggagaaaaattatgtgcctctcttagaaggcatattatttgttttgtcttcattctgcatgaagaactgtagggttttccctctccactctatgtaagaaaaatgataattttataatcctttatattctactttttaatttattttggtgcctggttaaaaaaagtacatacttagaaatgtggttggcatgtaagaagggtttaaaagataataaaatcgacaatttaggattgttgtaagtggtgctgaagtagaaaaaaatgaattgtgcttatctaagtacatgataactagatgtggaattagaggatgcaaattgagagatgtagaaaagttatttttttaaaaagaggcatgatttgaggatgatttttatacatggattggattaaattgttcagcaatgcttgcttattggtatcttcagtttcatatgaggataatagtagtatctaaaactcagctgtccctgaaactcttggctgggcagggagtttactaattcctgttaaaagcttgactggaaaattaataattctgaaaaacatgctatcaattcattattctaaaagcttctcctgtatttttcaagtcctgtcaaaagctggctctcatagaaagcaaggaaggtcgccaaaatgagagcaaatagaggccactcaatcagaccttgttataacaaaggtcaccgaccttcacttgtgtgactcacagaagtcacacttgtggcagagactcaaaggtagacagagaagtgggttaactttgtactaaaaaaaaaaagaatctgggaagacctcagttttgctctgattggaggttgttggcatggggaagctgtaggtgggcaacctagaatgggaggcatcttttatgtttggctagggaacataattgactttctctggggttggccctgcattcaaagcagggcaaaaattggggaagctgacagtccttgaccaagtcctaattctcctgcattgattgctgcagaggttgtgcatcagagttctattgtcacgtatgatctctcactccccagatattacctacagaacctgttggttagacaaacctgaaattgtttcttatctgggtaagagagaatgcaatctcacaaagatatgacagtggattggggtggggagagtaaaagtcagtttgttgagaattggaagtttgatttaaggcaagtctttcaaacagagaaaatttgattagagttgggtaaggataaggatacaactaagaccgtttgaagcagcaagataaggattttgtggtgagtgagtcaatgcctgttgatgtttgtcattgaggagatctttaaggaagttcctatagtgaacaatcaaaccattttgcttgggcaggagactcctgcaaaaagagtcatgctattgacaaaataagagcaaactcatgtttatagagacagtgaggaatggttttattttatttaattatttatattttcatttttatagagatggagtcttgctatgttgcccaggctcttcccaaactcctgtgctctagtgatcctcctgtcttggcctcccaaagtgctgaaattataggcatgagccacccacccagcctgaagtgtggtgttccttttcagtatatagaccaactgtgggagtagacagtttttgctctctttttacttggaccatatcttctttcttccccttagataacactgtcctgtattgaagcttgcacaatatatgaaatagtcatgtcaaattcataatcacattttatgtgaggaaatctctcagaattttgcactgcattctatttcctagtattattctctacaaatactgtttattcttcctaaaggtgttctctatgggtctaagaatccttgcattatttggaacttgaacttgtttgcttttgctgactgtggaagggacactaccaggacactttgagctaatggggaaaagctactgagttggggaagcagtgctacttctggtgaatagtataatgtagtagcttggtgcaaaagtaattgtggtttttgctgtttaaaagtaatggcaaaaacacagctatttctgcaccatcctaataggtattgtccctgaggaggattaaggatgggtggcactagaatgtctatgtagtagaagattttttaaagaagtgatatgtctatgagaaacatgcactctatattgctgtatttgtctttcaagtaacttcagggtgtataaccactaaagccataacttggcatctgctactggctgaatgcagatttgctcaaaggtagtaattattcaagatgtggaaattttcctaatgaaagacttagatcagagaattcaagactaaaaggttcccaagaaaccagaaaattatcttagtgagcagtactttcagatcacatacatatatcccaggacacatctttcctaggtctgtgacatcttaccctgttcaccatgttcatctttcctttcctttgaaaatgccccaggctccttatgttaattattccatccagtttgcagagctctgcatgcaaagatgtgacatgccgagtcacaagaaaggcctgttttacctattccctagagcaggagacatctttctctctcttgcatttttttttttttttttttttttttttgactgagaggtgtatctctcaaggaacatgtaggaaaagttaaatctgctccaaggttacttggttttgcacaaatctagagtaattacttgtttcttttgcttaaaaatgatcaatcaataaatggagtaggaagcatctggtggggacatgcatacactacttcacaagtaaatgaatatgtaatgctgatcagctgaatattatactttgatttgttgcctaaagagtcttagaaatattggcatttttttaatgaggtaaatgtacgtatgagagagagctgaataagcaccttaaattctatatgtgacagatgagttggtcctggaagaaactgaaagactttgaagaataacgtgttgtatgattagaattaagacagtacaggcatttcttcatttacaaaaaaaaaaaatttagggtcagggtttcatgtgcaggttatataggtaaactgcatgccacaggagtatggtttacagactgattatttcatcacccagatgatgagcatagtacctgataggtagtttttccttcctctccctcctcccactgtctaccctcaagtaggccctggtgtctgttgtcccttctttgtatccatatgtactcaatatttggttcccacttataagtgagaatatgtggtatttagttttctgttcctgtgttagttcacttaagataatggcctccacctccatccatgttgctgcaaaagacatgatctcattcatttttatggctgcatagtattctatggtgtatatgtaccacattttctttattcagtctactcttgatgggcattaaggttgattctattactttgctttcatgagtggtgctgtaatgaacatgcacatgcatctgtctgtgtggtagcataatttatatttttggaggtatatacccaataatgggattgataggtcgaatggtagtttaagttctttgagaaatctcaaaactgctttctacagtggttgaattaatttacattctaatcaacagtggataagcatttctttttctctgcagccttgccagcatcttttgtcccctgactttttaataatggccattctgactggtgtgaaatatctcattgtggttttgatttgcatttctctaatgattagtgttattgagcattttttcatatcttgttgtttgcgtgtatgtcttcttttaagaagtgactgtttatgcactctgcccacttttctaatggtgttgtttgtttaactgtttaagttccttatagactcttgatagccctttgtcagatgcctagtttgcaaatattttctcccattctgcaggttgtcagcttattctgttgatactttcttatgctctgcaggtgctctttagttttattaggtcctatttgttgatttttatttttgttgcaattgcttttggcatcttcatcatgaaatctttgccagagcctatgttcagagtggtatttcctagttttcttctggggtttgtatagttttaggttttacatctaagcctttaatccatcttgagttgatttttgtggatggtgaaaggaaaggatacaatttcaatctcttacacaaggctagccagttatcccagcaccatttattgaacatagagtcctttcctcattgcttgtttttgctgactttgttgatgatcagatggttttaggtgtgtgaccttatttctgcactttctattcggttccattgtctattgtgtttgtatttgtgccattgtctattgtgtttgtatttgtgccatgctgttttggttactgtagccttggagtatagtttgaagttgggtaatgtgatgcctccagctttgttctttttgcttaggattactttggctatttgggctcttttttggtctcacatgcattttagaatagtcttttctaattcagtgaaaaatgtcattggtgggtttgttaggaatagcattgaatctgtaagttgctttgggcagtatgtccattttagcagtattgattctttctgttcataagcatgaaatatttttccatttgtttgtatcatctttgatttatttcagcacagttttgtagttctccttgtagagatctttcgcctccctggttagctgttttcctagctttgtgtgtgtgtgtgaatgggactattgtgaatgggatttcattcttgatttggatctcatttgaatgttactggtgtatagaaatactactgtattttgtacattggtttcgtatcctgaaactttgcccaagttgtgtaacagatctaggagcttttgcgaagagactatagagttttctaggtataaaaccataataatctgcaggcagacagtttgacttctctgtttctatttggatgccttttatttctcttgcatgattgttctggctaggacttgcagtactatgttgaataggagtggtgagagtgagcattcctgtattgttgtgattcttaagagaagtgtttctagcttttcctcatttagtatgatgttatctgtggattttattgaaagccttttctgcatctattaagatgaccatgaggtttttggttttaattctgcttatgtgatgaatcacatttattcattcctatgtgttgaaccaaacttgcatcctagaaatgaagcctacttgatcgtggtggactagctttttgatgtgctgctggattcagtttgccagtattttgttgaaaatttttgcatctttgtatataaaggatattggcctgaagttttatttttttgttgtgtctctgcttgtttcggtatcaggatgatactggcctcatagaatgagttaaggaggagtcccttctcttcaattttttggaacagtttcagtaggaatggtaccagttcttctgtgtaattccggtagaattcaactgtgaatctgtgtggtccagggctttccctggttggtcggcttttaattattgattcaactttggaattcattattgctctgattagaatttcaatttcctgctgatttaaacttgggagtttgtatattgccaggaattatccatttattgtagatattctaatttgtgtgcatagaagagtttgaaatggtttctgcagggttttttgtgtttctgagacatcagtggtaatgtcccctttgtgatggtgtttatttggatcttctctctttttcttctttattagtctcactagctgtcgatcacatttattctttcaaagaaccaacttctggtttcattcatctttggaatggatttttgtgtctcaattacattcagttcagttctgattttggtttggggttgattttgcttttattttttgagttcctctaagagtgatattaggttgttaatttgagatctttctaaatttttgatgtggacatttagtgctataaactttcctcttagcactgctttagatgtattccagagattctagtatgttgtattattgttttaattagtttcacagaatgtcttgatttctgccttaattttattatttatcaaaaagtcattcaggatcaggttgtttaatttccatgtaattgtatggttttaagcaatcttcatagtactgacttctatttttgttgcactgtagtctgagagtgtgattggtatgatttcagttgtttttttttaatttactcagaattgtattatggctgattatgtggtttttagagtatgtgccatttacaaataataggaatgtatattttgttgtttttgattggagagttttatagatttctgttaggtccatttggtcaagtgtcaagtataggtcctgaatatctttgttagatttctgcgttggggatctaataatactgttagtagggtgttgaactcttttactattattgtggggttatctatgtctctttgtaggtctctaagaacttgctttattaatctgggtgctcctgtgtttggtacatatatatttagcatagtttaattgagcactttaccattatgtaatgcctttctttgtcttttgtatcattgtttgaaagtctgttttgtttgaaattagaataacaacccctgctttttggttttgcttggtttggttttatctttgctttgaccctatgagtgtcttgaagacagcatacagttgggtcttgtccctttattcaacttgccagcataccttttaagtgggggcatttgtcctatttatattcaaggttaatattgatatatgtggatttgaccctgtcatcctgatgttagctggttattattcagacttgattgtgtaattactttatagtgtaaatgatctatgtatgtaagtgtgtttttggtggctggtaatggcctgtttctatatttaacccctgtgtaaggtacctcttatgaggcaggtctggtggtaacaaatttccttagcatttgcttttctgaaaaggcttttatttctcctttttaaatgaagcttaatttggctgtataagaaatcatggttggaatttcttttctttaagaatgctgaatataggcccatgatttcttctcacttgtaggattcctgatgaaaggtcgactgttggcccaatggggttccctttgtaggtgacctgacccttctttctagctgccttaaaaaaaatttttttttacatgttgaccttggagaatatgatgactatatttcttgggaaagtcatcttttatagcatcacacaggaggtctctgcatttcctgagtttgaatgttggcctatgtagtgagattggggaaattttcatggacaatatcttcaaacatcttatccaacttgcttgctttctctcccatttcttacttttaacgatagtgcgaggccataaaaatgactgtatgttgaaactcacaacgtgatcttaataatcaatgggagaattatgattgctctgtgacctttaaatttttgtcaaagtatttaaaactcttttgctctaaattgtacatccataggggaaaataatagtaaaacttccatttgagggctctagttatcttataaagtaactagataattttactagtaaactaatattatttagtgcattataatttaaacattagaaacattgagaaagtgttttttatatataatttaattaatcctaattatcaattttgtataaaaattaagtacttatctttttcttctccttatataacttatatctaatgagcatcctttctacccattggaagcaatttggaaaatgtgtcttttgctaatagaggattttcatttcttcaatttaaaaagtcatagtttgggtaaggggaattaaaaattatctgcaccttaattacaaatcaagtctttacagaattatcatttagccttttggagtattaaccaatgcaataatagttgaaatgtggagcaattgctgggctgtatcaaagattatcatacaactgagacatataagggatgtggagtcacttaccccatcttttcctcaatgtagggattatctttttaaaatttgtgaacattctgatacttttgaaagttgttccttaagagagcttcacatcatatctaatacagtgatcactgaaaaatttattcttgttaagtcaaagacttctcattacctttccttggtcccttattcttttctctagatcttaagaactaagcccacttgttgaacaggatactcgctaaacattcagacagctttcctgctcacgtccctcttttctctaagctgtagtttattctagtgccttctgatttctgaaaacctcataggatacttagttccaccctctttactctttttatagtgcttatccccaagagagtttattaatttggaaattttatccttttggtaatcctgattgctgtagtgccgaagagcaaggtcgtacatcttgggagatggaatcttgatttgatcctcaagtcagtggaaagccatttacgggttatatgtagtaggcagaggagtgagataaacagatttgcatttttatgaagatacctgcgcagcattttggaaaaaggaatggagtcgatgagggacagtgggatctgcaggggagtttaattatgaattgatcagggtgagtctttcaagtacctttctgtcaatgagcatttataaggtctctccaattatttctgggagtctttctatttctgctctggcagagtaaaatagatgattagttaagatcttacgttagacacccaaaggacttgcagaaatagttggcgagactttgagatggagaatcttaagtcttgtagttatgtaggtaggagtttgtgtactagagaattttaatattgatgttaatatactttaatttttaccaatatgctgttgaggttaggacacattcagggtacattttcacttataataaattattcttcatatgtgtctatctctcactagactatttattgtctgactgatgtttgagagactgacatgttagtgtttatgtctttgtaaatagcagagcatctggaacatattagaaaaaatatgaatgaatgaatgatagacataatgtgtagttgttattgaaattatgtatttcggtgagttggataaaatttgtctgttatttaccttgtttaaaaataaattgatgtgagttaaaatttagtaatgaagagcagcattgtaaatactacaaaaaacatttccagataatatttaatagctttacaagtgtgtctttaatgaacttaagatataccttcccctgtaattgctgacaactgtgttgttgtaggttggagatcacacgtgcttatcagaggtactattgacttatacttgttctgcttattgattacttaattagttttctaagatagctaatcagagagagatgtaggtatttaggagtctttcattaaaacatgctaagaaatttaaaacagaaatgtgtgacctgaaaggaaagctcagtaaaggcagagttcttgaggaccttggatataatgtaatgtcctactgtaggtaaaactggtataatttaatttctattttcttcttcagaataatgatatatttttttgttccattggttagggaaatatatcacatgcatgcctctatgatttatgggtatttccatttccatctgaattgtagattagcagaagtaagtgcacatttctacgacctatatattaaacacacttaacttttgacactttctctttttattggaattctattgataaaatataaaactaatgggaactttctctttttattggacttctattgataaaatataaaactaatgggaactttccctttttattggaattctactgataaaatataaaaataatgggaactttctctttttattggaattctattgataaaatataaaactcatatttcattattttttaaagttttgtttgtttatttatttatttatttttagatggagtctcattctgttgcccaggctggagtgcagtggcgcgatctcagctcactgcgacctccacctcccgggttcacgccattgtcctgcctcagcctcccgattagctgggactacaggcgcccgccaccaagcccagctaattttttgtatttttagtagagatgaggtttcaccgtgttagtcagggtggtctcgatctcctgacctcgtgatctgcccgtctctgcctccctaaaggtttattttttaatccaaatccgttttgtgtttctgttcaaatactaactaatataatatgggatattagtgaagtccttcatctaacaattctttaacttcaattatcttctttagaaaatgagttgttctcatcttcttatttaaattaattaataaacactagcacttttacatcatatcctgtgttttatgtaaaataaactctcataaagtttacactattttttttaaaagaagtgacttctaatgttatactttcctcacaatcagagtttttaaagaaaagtcataggaatattttgctctttctacatatctgtacattttattagttggtttgctgtcatgctttttcttaatattaaagttgaccaaaacaaaacagaataggtaaaactgtgcagtaatgaaagctgatcattaatgacatgtccttaaattgagctttgagatatgtacattgagataagaatatttattctggagaattctagatgctgcacttaacggtaaatttgctaaatagttctgatcttggaatttttacatactagtgtggaaagcttttattgttcagttatatcattattttattaaaactgtttattcatatgacttttgggaaacattacagagctggtttgtcacaagttctttgtacctaacagaatgagaaatgagatgataaaatagaatacagttttatttttctgttttaagcttaatacctaaaagatgtatgaactattaagtaaaaaaacactcaattattcattctttcatccaagtatataaccaatttattaagcatatatgtgctcatgtgaaaattgaataagagctttttgtttcagagcaattttttatttaaaaattcttaacataaagtaatacaagactcatctatacctctagctttcactgattccttgctttaatcattcgtctagtaattcaactgatatttattcagcaacagctgctcatttacataaaataagaaacaatatgttcaggaattggaggatattaaaaaacagttatcttaagcttaagtttggaaaaataacgtatatagaggattacttaaaaatttgtatagatttaattgtgtaaaatgtgagaaaagggaacaaattgcaaatgaaacaaatgaagaaaaagtacatgttttccatctttcttcaattgctgttttttgttgtttgtacataatttagaggcatagattggattagtagtatatcacttttcatatagtttatttgaaaacttgtattccctcttccggtctcatcccctatcttcccctactaatggtaaggaaaacaagttggttggtaattgaatataatagcattcatcccagcaggttgcatagtctccgctactgcaatagttcaaaaccagtgggatgatttggattagaaaattgaaggtaaaatgaactattaatgtaaatgaaggaaggcactgtgatttgttgaggaagaaaacaaagagtatgtaattccagtgtcctaagaggcagagagacttttagaaagccccacccctatcatgaggtcaggagatcaagaccatcctggccaacatagtgaaaccccatctctactaaaaatacaaaaaattagccaggcatggtggcgggcacctgtagtcctagctattcgggaggctgaggcaggagaatggcgtgaacctgggaggcggagctttcagtgagctgagattgcgccactgcaccccagcctgggtgacagagcgagactccgtctaaaaaaaaaaaaaacgaaaaccccacctctttcagtggcaaagcttattctaatagtgttcaaaataagtctcaggtacctatgactataacaaattgggttcttaggaaaatatttttgctacaattagttttttgggggatgcttgtacatgataaaaaggaggaggagtatttctgaagtgatattttgggtgggtctgctaactatatagattctggaaccatgtctatcaggcgaagtgtttttaaaccatcttttgataagtataggtcagactttggtgttatcatggattcattggcacacctccctgatccctcttcagggccaatacacccatccataattacctacagtgcctgatgcgcctcacttcaacttcaggaaagtgcctgggacaaggttatacctctcaggggacagcctacaaccactgacaaactcatgcatggacacaaatgttgggcccccttgtctcacttcaggacagctctgcaggagctgacactgcttgacaatgaagatcctttcagaagtggccactcagcccaaagatgtgaggataaagggatttgaacaaagatgaggattaaaaacttcccataactctgggtaatttattctacaaaggcagaatcttcatcctgaagaggtcaagttgaattgctagggttctgtatcctggtgtttagatcaggattaagaaaatggcacaagcattctaaactacctggagggaacttttcccagtcttagcatgtgcattatatggcatgggcttaaccagcaaaagctctcaaattccttctacttggagtggatgtggggggaatgacaagttctaccacacagagtatgtgaacaaggcaggcttatataactcctttaggatcaacaagtgaggcttgagggttccagtggttgattcacactgtcagctaaggtgatgttttacattaagtacacagggaggaatagtgatcttcctatgagttaggaagagaagagaaaccccattcagatattcctctgtgtatttatatggagagtagacttgcctttattccttctctttttattcagccatttatgggcacacttcaccctggttcatagcataatcaatctcaaaacctatcttggcagatatatttgctgtaacacctcagaaaacacaaacaatggatcttttatgaatatcatgaatcagggcttaagttaaaggttagcccagatgaaacagaaaattagagattaaatagtttgccctctcttgtcaattccagcttatatcttgtcactctttatagccaaatgaagaaaaaaaagcacaaccacgtatattttaaattatttcattgattaaagtagtatcaattcaaaatggcatcaaaaccaaaaatttcctctttgccattctgaaatttactcaaggccagaaggagaatagaacatagacctttaatatttttggtgacaagaagtttgaagggctgctaaacaaaagaaggagcaggggcgaatggggaagaaagaggagcaaggaccgccccagttacacatctgagaaaaccaatccagttcacttttcaaagatgcagggcacaaattgagacacaggactacatcttttatttgcagagatcagaatggggttattagcttgaatcaggaactttctagactatagtttgtttctcacaaaaaaagggctcagataaataaggaatgttcaccaaagctgtaatttcaggaagtagctggaagtccttgagttgtgtaaagcaagttagtttcctatttccattagctgttaagaagtaaaggctaattgagctgccgctcaaaaccgtaggtcagaaaaaaaaaaaaatccctctcagaccataactctgattctttctaaacaaaagccacatataaatagatcaccaagaaaaaaattaggaacataaaggctaaataatcaaaagggaaccaacaaagattctacacggaaaaaaaaaggaacataaaagacaaagagcagagaagaaaaatacttacaaaaataataaaatgtagccatgtagcagataaaaataaaccatcttgacaaaaatttaaagatcgtatgcctctgtgaagcacataccagagtgaaacaagtgctcatagagaatatggagacataagagacttattatatatcttaattaaaaaaaaaattatttaaaacagtctcaactcccaagttttctcatgccattgatttgttggatgctggcactttctaggtctcttcctcaagtagttaataacaaataaccaaatgacccacaaacagatttttgaccacagatatccagtcatgccaccttgaataacattgaggtcacttcactttttagatagttaatgcatgctagggagtgaagttgtaataacttccagtagtcaaaagcaattgtaaaacactgaaaattgtattaccccatggattttaatagtacatcccaatttcagagttgttaaaagtgtgataaaatgtgtatttttaaatttaaagaatagattaaaatgtactgtcagaactaagacaaacatctgtaatacaaataaataaaaatgggttgaatttaactattgaaagaaaaatgtgttatatttaatcacatatcaaagtccaattttgttctttcaacaacaaatatttctaaaataaggcattcttatagattgataaaaacatgggcaaagatataaaaataaaatgctaataaacaaatatcaagggtcatgataattatatcaccatatgttgaattaaggcaataattactaattgacataaaattatagtgctaaagtatatactatacaattatgtatagcaattatactaaatttgcatgcaagcaatatatcaacatccatagaagcaaaaaccataggaaaaaatattaaatagaacaaaatcacattcttattataagtaaaaaactttaatttgcctgtcttagaccatgatagatttaaacaaacaaaatttaaaaatataaattatataattaattaggtgcattaatgttgtataatgctataacctgaaaagaacaaatacatattatttttcatatcaatggaaaattcacaggaattgataacatcttagattgtaaaaacagtcttaattaagcaaatcagaagtagtatagaaaacattgctgtactgaaggtatactaataatgcactgaaaaatatattaataacaaaattaaaaagtaagattcctaccactttgatattaaaagataaaaatcctctctataacacttttattaaaaagtaattctaaaataaaacattgtagtaattatagaaaattaacataatgaaaatgctgaatatccagattagtgaaatagaggtagcagtgctcagaaatatattcatagaccaaaactatcttctattagtaaaaaagaagttaaacgaaataagcatataatttatggaaacatggacctatgaaaaccaaacattaataaaggtaacactggaaaaaggtgaatcaaaaaaataaaaagcaaaacagtaaaaaacttcataagaaaagaaatctcagagctaagtgggtgtttgtttgtttttgtttttgagatggagtctcccattgtcactcagtctggagtgcagtggcgccatctcagctcactgcaacccccgccaccacgaccggctaatttctgtatttttagtagagacaggctttcactcttttgagcaggcttgtccagaactcctgacctcaggtgatatccacctgccttgggctcccaaagtgctgaaattacaggcgtgagccacagcacctagctgctaagtgttttcttttttctttttttttttctttttcttgagacagagtctcgctctgtcacacaggctggagtgcaatggcatgatagctcactgcaagctctgcctccctggttgaaatgattctgcctcagcctcccaagtacctggggttacaggcacataccactactcctggctaatttttgtatttttgtagagatgggtttcaccatgttgtcctggctggtcttgaactcctgacctcgtgatccacctgcctcagccttccaaagtgctgggattacaggcatgagccaccatgcctggcatatgtgtttttttaaagaaaaaaaaaattggctaacccaacagagaaaaattgaatatatgttaatttaatagtggtaatcatcacacaatgtctatgtatatcaaataaaagatgaaaaagcaaaaagaaaaatggaaaacggcaataaatccgaaaagaaagaaaatggaaggaaggaagggaagggaaatgaacgaaagggattaaaggcaggaaggaaggaagggacgaagggacaagagcaaaataatataaacaaggatgaaaatggcacaaattatgttcaatcatataaaaataaatgtgaaatatgaatttgaggagaaaacatagttatctgtggattgtcataacagcatttgatagaattttttgtaaggcagaagtaaatggctaattctaatgtatgattaaaatgtatattaggccgggtgcggtggctcacgcctgtaatcccagcactttgggaggccgaggcgggtggatcatgaggtcaggagatcgagaccgtcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaaaaaaaaaaaatgtatattaatgtatagtataaatatgtgaaacatatataatatggttattatgtataatcaactgtaaaaagaatgtatcaactcctaaactaaaattatgcttaatgtaaaaaacctttaaaaagtcccattgaattcagaattaaagcaaggctattcattatcaccactactgtttaataaaaagtcagttaaagaagacattgaaacaataagtataaaattgagaatgttttccaggcatataagcattatcttatccaataatgatgaattgtctgaaaaataaagaaaataaacagaaaatctactataaacaaaataattcagcaaattaataactttttctattcataaatgacaatgtttaaacatagaatgggagagaagactcattttttactatggtagcaaaaaatactataaataaacttgaagtaatgtgcaaaagctatataaagctctatggacatggaagactgaactcttatcctaaagagaattggttacctgtaaattaatctctggaattcataggatcccaataaaataccatagagattattttagtaccttatgtcatgatttctggataagaaaaaagaataaataactaaaatcatctgaaaatgaagagtaatgaagggaagctagccatgctggatattgaaatttattacaatatttcaatcatttaagaagcatggtactgtacatatacttagaaaaagagtcagagcaacaataccaaaaacaataacagaaatagaacaaatacatcaaggaatttagtaaaagagtgataatcaaatcagagattatacaataaacagtgttggaacagtcttgtgtttatgagtgtattagtccattctcacactgctgtaaacatactacctgataatggataatttataagaaaggtttaattgactcacaattctgcatggctgggggaggcctcaggaaacttgcaatcatggtggaaggtgaaggggaagcaaggaccttcttcataaggtggcaggagagagatagcaagggcaggggaaatgcctgacatgtaccaaacaagcagatcctgcaagaattccctcactatcaagagaacagcataggggagactgcccccataatccagtcacctcccaccaggtcctttcctgaacacatggggattacaattcaagatgagatttaggtggggacacagagcaaaaccatattattccaccttggctcctctcaaatctcatgttcttttcacatttcaaaaccagtcatgccttcccaacagtcccccaacatcttaactcattccagcattaactcaaaagtccaagtccacaatttcatctgggacaaggcaagtcccttccacttatgagcctgtaaaatcaaaagcaagttagttacttcctagatacagtgggggtacaggcattgggtaccaaataggagaaaattggccaaaacaaggcacaggacctatgcacatccaaaacatggtgggggcagtcattaaatcttaaagctctgaaatgatctctttggaccccgtgtctcacacccagggcatgctgatgcaaagggtgggctcccatggccttgggcaggtctgcccctgtggctccagagtgtaaagccctggtggctgcctttcctttccagatggcattgagtgtctgtggcttttccaagcacatggtgcaagctgtcagaggatctaccattctggggtctggaggacagtggcccttttctcacagctccactaggctctactagtgccccagtggggatcctgtgtggggactccaaccccacattcccctctttattgctcaagtagagtttcaacatgagggctctgcccctgcagcaggcttctgcatggacatccaggcatttccatacatcctctgaaatttacgtggaggctgccaagcctcacctcttgtcttctgcacacctgcagtcccaacatcacatggaaaccaccaaggctttggacttgggctcccctgaatcaacagcccgagctgtaccttggcctcctttagccatggctggaggtggagcatctggacacagggcactaagtcctcaggctacacagaggaatggagccctagacctggcccacgaaaccattttttcctcctaggcctctaggcctgtgatgggaggggctgtctcaaagatctctgacatgccctgagacatgttcttcattgtcttggctattaaatttggctcctcattacttatgcaaatttctgcacccagctcgaacttctccccagaaagtggggttttctatcacggtcagtctgcaaatcttccaaaccattatgatctgcttcctttttaaacataagttccaatttcaaatcatctctttgtgaacacatataaccatacactttcaggaaaagctagatcacttcttgaatactttgctgcttggaaatttcttctgcgagataccctaagtcatcactctgaagttcaaatttgcatagatctctaggtaaggtgcaaaatgctgccagtctctttgctaaagcatagcaagagtcacctttgcttcacttcccaagaagtccctcatctccatctgagaccacctcagtctggacttcattgtccgtattactatcagcattttggtcaaaaccattcaacaagtctctagaaagttccaaattttccctcatttttctatcttcttctgatccctccaaactgttccaaagtcttcctgttacccatttccacagttgcttccacattttcaagttatctttgtagcagtatcccactatcctggtaccaagtctctgtattagttcattctcacactgccataaacatactacctgaaactgggtaatttataagaaagagggattaattgcctcacagttctgcatggctgggggagggctcaggaaacttccaatcatggtggaaggtcaaggggaagcaagtaccttcttcacaaggcagcaggagagagagcgcaagtgcagggtaaacactggacacttatcaaacaaccagatcctatcagaactccctcattatcaagggtacaacatggggaaagccactgccatgatccagtcacctcccaccagatccctcccttgacacgtagggattataatttgagatgagatttgggtggagatacagagcaacaccatatcaataaggaaaaataaataaattttacattatatataataccttaagccctcagtattttaaattgagcaaataaaaagaagagaaaagataagaaatggaaaatattaaaagaagataatgactataaatatacaagtatatatgtatatttatgtataaaaatatgtgtattatatatataaatgtcataccaaaaaagatcttctcaataaatatatgtgaaaccaaaaccgaattgaagaagataatatgtaaacacataaaaaaatagttgagcattgtggcacatgcctatagtcccagctattcaggaagctgaggcaggaggatcacctgagccctagagtttgaggctacagtgagctatgaggctggagttactgcactccagcctgggcaacaacaaagtgagaccccatcgttaatcagtcaatcagttttaaagacagcatcaccataagcgaaatataacaaaatgacagattttgatatgtattttcttaagatatttataaagagcttttgaaaaatataaattgatatgaaaaagaacagttcaatagaaaaataggctggagatctgaccaaactgttcacagaaaataaatagctcttaaacatatcagataacctcaaagtcactctttggtgcataactttggagagacaggtgttccatgaatagatgaaaagtggtttgacaactgttattgaaattaccatgcgcatctgaaaatttttctgtgggtacattcctatatgtacaagaggatatagataaaactttacacaatattatttgtgataacaaaacattggaaataaaccaaatgtgcttcaataagccagaggttaaataaattacaacccatatacacaatccatgtaagatatattatatatgcatattcccatatatataagtgaacactgattaaataatttatattcatccacattatagaatcaaaagcagctttcaaaaggattgatgaagtctctatgtactgatgggagataatcccccaattatactaaatgatttgccaagagtatgtttactttaatttttaaaactatttgtatataaaagaacaaagaacatttgtacatatttgttgaatatgcaacattatatatctacatacaagagactgataacaatttgcaacttttaggaaaaggaattgcaggtctaggggagaattgtaggttaggaaactttcactgagtaactttgatacgcttcctgaattttgaaccattcacaaattattaatttcggaagcatccaacatctatcaaaattggttgaataaactaccaaatttcttgttaatgtaagctcagttaagtagattttatatattgaagtacaatgagaattcatgtagcctttacaagcatgtagcccaagtgcataggaaaatccattagctgcataatttatagccaatttaaaatatttaatttgagcaagaagttgacactctgctatcccactgcctgaaaaaaaaaaaaaactttctgaatcaaggacacaaatattaaaattgtattgaacatcttattgaatttttagcctaaatgaaaattacaggttgctttggtaataacaaccaaataaaatctggggtaggatgaagctttaagcacaactgatgctatttagtccaattacttgactgaaatacaaagaatgtaacactttgtaaaattatctttactttggggtaaaagtgtcttccactttttattaacttagattcagataattttatatttggaaagtccttaaagctcacgtttccatcaggattttacaaagccatctttactctgatttcccagaaataacaactataactttgtttgctaacgatttactctttagcatctctacccaaagtcagcctaaatccctcatttgcaatttacatttatttccagacgttctggatgagaaagacatggaaaattttgtactggtggtatttctttctataacaacctttcatatattctaaatcatttattatacttttctcaaagtatttctataatatcaggtttaaaaatgaggaagctaaattatatttccataagtgaagtcatcattagtacttacattagaatgttttattagatgacataaaaaattacgcagaaaattggaaaaggtacttttctttgttgttacatgtacattctagtaggtatgattaaatctgagtgatttattattttggtttatatgctttctactgtttgcttaaacgttgttcatctgtagttgttttcctggcagatctatttcttttttattaaagcatgttcaaatgtttgttctcattctgcatccgcaaattcaatgtttaaacttagcaccttcttagaatttgaatttagaaggctacctttctttacatccatgatttttatcagtctctattctgaccgagtaagaaatagacacatatgggaggttttctattttagcagaaaaatggtatactaaatcttttaaaaaataaaacatcatttgaagtcagtagagagctactgcttctttttatgtgtctgatcatttgcttagcactgttttagttatgtatctgattaattttgaatagcacacattaattaaaatttaataacacttcatttaattaggttaggtattctcaaaagcactccagagctagatttcatgattcataggagcaaaaatacccacttcttactcaacataatgatcccatgtttaaaaggaatatagtcagagcagcagggatgaagcacataaaaacttgcactacatattattttgtgatattttagttataatcctttgtttctaaattaactcatctttcatagtatgagatacagcaaagagattgaaaacattatgttagatgctggagggcaaaacaaagaatgaaacagtgtctgaccttaaggatattaaatctaaaccaaaggacttttattattgtactttcaaatttctgaatagatgatcagaggctgggtaattcagcaactgcatacagatttttaccatcttgctgccctgttatcctgagcttgtttccttctgcatgatgtcaagatagctgcctcaattctaatgtcatgtggcaagctcaagtggaaaagggtaggaaaagagactagatgtgtctctttagcaatgagagaatcttttcaggaacccttaaacagacttttcatccgtcagaattgccgcataccactgtttctaaagcaataaccaacagagggaatgtgtttgccatgattagcttagttaagcacatggccctgtaaaaacaagttttgacagaacaaaattgggcttttgctaaccaggatggaagagagaagggatgtatattctgtaagcaactatcagtgtctgctatataattgaaaatttttgaagagggaagtgtcatgatcaatctgtgcttttttgtcttggcaattaaaatgtacgttgacctacttggaaaatcacagtcctaggtttcacggaaactggctattttatgcttctttttattctctctttctaccttttttctttctcttcttattatcttaattattatttcaattattaagtttttatgtctatcaccaatattttctgtttttcctcttaaatgccattaccttctatattcaccttagtctgttcacattatttcttttgtagacaacgaaaatagccataaaacatgtctaccttaatttactattatgcctctatggtaggactggctacatcatttgtagggtctactgtaaaaataagatgtggggcttctgttaaagacgtattaagaacttcagcgtggcaacagtagagtatcaaattcaagcatgggaccctgtgggactgcacaagctgcatgcctgtgaggctgggccctgctttccaacttgtcctccacccagtgccctcaaatatcttttctgttgctctcagaatgaggatctacatctttaatatgaactaaatgttatcagcttaattatcttatctgcatctacaacataccagcccctgttcttacttctgtgctctagccatggtaatctttcactgactctcttttatcatcataccactagacatttgcaaattctgtttctctcacaacattcattacatcctctttcaaccttcactgacttcataaatttggcaaattatcgtgtgatgttttttgtagccattgtaatataaattacaatatttttgctcactaattttctttttccttcttgttattggccatttactcaggaagttcaaatttatttatttatacattaaaaccttactgcctagtacagggccaggcctgtacaagagtctcaaaaatactcatcaattgaatggcagtataggagtgataaaagagttgagagtaggacaaatgtagtttttgtcatcataatgtttacaatataggaaaactagcaggtaattctatgaagcatgtccattagtttcaatatctgtaaaatatttgaaattaaatcaatgaaagattatttattaatattttcctcctcataaaagtcttacaggctttatttgtggagaatagaatggcctgccaacacatgctgtgtttgacatggataacactgctttgcctaggaatggacattaacagagttacgtgaatttaagtatttaacatacttttttcattgatactcaacgaagagctattttcctaaataaatttgaaatatacatatggcttacccatgtgactgattatcagccaactatacattggcatcaggaactggaatgaacttggtgggtgtcttgaagaaggttcatctcccttcaatagtcatagaataaatagcttggttacatttatacttaaaacaacagaattattgtacttattcataatgctaagtgttttaagtggtctagaaagcatttattaatgttatgttctgtcttcttagtgactatagatggtaaaatttttcaaagaaaagtttcactcttctaaagggtccttggattttgtccttggtttgaaagtagttttaatagatctatttaaaacaacctaaagtgcatgtattttgtgaatagatgaccaatttcataaccttctctcctatcaaaaagaagactagttgttctttttcattgatgtgatattcagacagaggaaggcttctttaagttcttgttaaagttattgcagataccagatgatacgctcaaagaactttgcttgttgtctttttaactttccacttctttaatcatagctaggtgacaagtctttaaaaagtcttaatatttgctaagtgtaagtaaagctttcattaatgattcttgagttattggtgcacagaagaggcttagaaaaggtgaagcaatttgaggtgaagaaagcaatactttttctctccatcattccatcacttaaatatattagaatatgtttctgttacccttccaaggaagatgtatcttctgaactgtagtcataattttttttcaaaaaatataaattctttaaggtaatttgtaagacagaattcaaatatgtaactagttctgttttcttctatagcttatatttatgtataaaactcttgcattacacttaaaatacataaatggtgtcagtgtgtataaattcctaaataaaatatttattgtaaaatataagctgggtaaatgctttctccacgtttgaattccagtctctatagttggaattctaattttctgccatagtagtaattttacagtaaagcacacatatctatcaaagtcagaatagttgatgtcagattcagatttaccatattttgcttaggcttttcatgaagcatataataacaaccattgttctgtgttgtctgcgctagagtcatatgaaatataagtgagtacatgatgagggttctaagcttgacatttccattatgcattcatcttcctattccccttctaccttctcttgctctctttctctcaccatatatatatatgtatatctttctcactatatatctatacacatatatacacttgtgcatatatgtgtgtatgtgtatatacatgcacatacacacacttatgtctcattctctatttttattaaaaaattcattgtaataaagctgtactctatagttatagatttatataaaagtatgtcttatatgttggctacataacacaattaaatgcaaataccaaagatacagaatttaaatgttagttgttggcttttgaagctaaaatgaaattatttattcattcatgaagcaaatggttacttaatatctgttatgtattagagtacaataaatgaccttcttcctatttctaggcctctattcccccaatgcctttttggggtactttattaatttttctggttcatgcaaataaagtagagttagagaactaaaaactaaaatatagttttagattcttcatgaatccagccaagatagattatcagatttttttttctctttctacagtgcctctgaggctaacttaggaccatctaggcataaaagaaaagctgatttcctgtcatgaaagtaattcctacttggacttaatgacttaccatagcaccattcttcaaccttttcattttttggcatattgcaaaatatctaaattttctagggaaatgtcaggggttaggggagacttctatttgtatggtagtgaaaagctttttcttagtatcgtaatagaaagaagaagagactagatggaaacggaagtgaatagaagaaaagcagtttaaaagacaggaatggtaaattagatatgtgtattttaccaccattataaaacaaaatgcacgagtgggacttacagtctttgcttcaacatgtgaagaagttggaagtcataattcctgactttaccataacaaaaagctgaataaactgaaaatcaatgacattttttaggcacataagagaaatgatatcttggggcagactgccatgctgaaatctagagagatgggctaatccagagagccacatcaaagatctgcttacttgaagcagaagccactggagccatacctggtagagacacaaggtaattttaataagttgctagagcctatggaataacacaaaagtgagaaacttattggggctacattgttggtggggaggtcattgtatttgtataggttttacatcctgtggaactgagaaatattctctcatagatatggaagggggatttcccccacgacagcccactctatcttttctttgtcacctaagctgggagaagggagaagctaagaaaaacttgggacataaccagggacacagagccacgaaaagactgagatttaaccataaggtagtagaatctttcccattctccacaccttaccacacatcaacaaagctctagtataataataaattacagctgaaagagctttaagacagacttaaagtaaagaaatggtgacaaatatgccatggtcaaaagaaagctgaagtatctattatgattttagagaaaacagacataagaacaaggaaaattatcagaaataggagagacactgcttaataataaagggatcaattctccaagaagacccaaaaaccctaaacatgcatgtacctaacaacagatatcaaaatatgtgacaaaaaacctgatagaactgaaaggagaaacagacaaaatcactattataattcgagtctttaatactcctccctcagtaactgatacataaagcagacaaaaactcattagcaatataattgacccaaatagcagtataaatcaacttcatctaactgatctttatagaatataaaacagcagagtacacattattctcaagctcacatgaagtatccaccaaagtagatcatattctgtgcccataacagaccagaacagaatgtagaaagggaaagtgatagaggagaagatttatctcaaaataattttggcagaaaaaaattataggtaggaggaacaaagaataaagctaggaaaacagtaaaagtaaataatagctaccacctcttactgagcttttactgtatataggtgggttctgttcccagcacattatatacatgacttgatttaatcatcttccactttcatctgggcttttgtcatcatttgcagatgaggaaactgagactcgaagaatatgagcaatttgtaagtgacagagccgagatttaaagccagagacctaaccttaaccaagacttgactttgttgactctttaaatatggagtcaaggtaccttttgtgaagctgggttggatggcttaaatctaaaactgattcattcatgagtaagagttttagagagtgaccagtgcctggtagagtatttgcatttttctcaggtcctatttctcatcagtctcaagcttccctacttccggccagctattcttggctctcatattcctaccagtaaatcttgttttcctctgcaggtcaagttattgctgctaggatactttcatcaaatatcccacgttgatcacttcatattatttaaaatatgtatgtgaaaagactattggtgactttgcaaatagaagtcacaagtatatattattcttgggtaatgggatgaagattgagatacaagtaagataaagaagattgttaaaatcagacagcatctttttctctcctaaattgtgaaataatgtttttcacagaaaatatatattgtggtacattcatgcttcataagggcaaggactataacttattcagcttcgtttcctccagcttgggtcttcataaatagaagttgttttaataaatgttaaatgaattgtaatccttaataattattttaaatagtaaaacatgcctcaagttttaggaaaagctcataaatatattgcatataaaattaagtatattttatacaaaggaatgaagtatgctgtacatagagaacataaataatataactctaatgtatcataaatttggtctaaagctaacaagctagctataaaaagcatttccaatttcttgtgcctttaaatttaaaagagcttgttagaagggttaggatgaactaagtttctataaaaggctgaccttggaactttgaattatactttcctttgatctcagtatatgtcccttaacaaacaaaaaatcatttcatttcttggtctagagctgagctcttcagaataaacagtctagtttattctgtgcatttcaatgcacagtgttaaactggtaaaccagcacatcagtaggtaaaggcacttgaaatgttcttctagattaaatatcttcagataaaccaaatgaagaaaattatggatatcctatatgaccacacatattaaattccagggtgttactatgaaagcaactttttcttggattctgatttccatccttcatgatcaaacaagtattttgtcagttaaaaatttaaatatgccatcttacaatggatgagtgctacaatatgactcagtgcagaaattgttctttaatcacagggttgaaatactagcatgtgttaaaatatattggaacgtcactacagcagttatataattatcctttaaatgttttctttttgagtctcttgtattattatagttggatcatgtaatatagttattagtgtatgtgaaacaatagaactgtgctgtactaaattttaaagtatgcacgtgtgtgtttgtgatagtgtgtgggctgtgaataatattttgtctaagatacaagtattctaatgtatcttagaaggtctctttattttcactaattggtttcagaacgtgtggtttgagctattcaactaaatagactggttatttgactttgagtatcttgattgttttcctgttgtatcaaccaactgttttgattccacatacagttaatttcttttttttccttccttccttccttcatctttatgactgaggataacattactcactgtctttacttcaaacaaaatgaactttgagtggttgtatagcttagagtcatttactagtgacctttttaaatcattccatgcttcagtttcctcatttagaaccaacctcgtggagttcttttgaagaatgcattaaacatattaaagttctcaatatattgagaacccattcaaaggagtttcattacgaggaatatattcctttaggaatctttcagttccctgtttatattttttcagtaaatagttgtgtttttttttgtaaacttttccaggttttatttttttaaaaaattaatttctggttgcggagtgatgcttttgttttacattatttaatagtactattatggaattattactgcttcccaaaatcctgctcccttcccactcccacagattagtgaaggtaaacttttggaagatttatcacttgacgaatcaggtttcagctactgtacctcctagctggattatgaaggtattaaattcataattctgttactaatgcttccctccttcataaccataataatgtgctttcatcaggaagcatcttaaaatatatcatgtaaaggcccttgttactctatacctcccacactgtcacttccttggtacccttaattctttgaagcttgaatcatactgtgtatatatacttcatccatgtccagccttttaataatctttctcattgtggcataaagattgttgtactagtagaaaagaagttccatttcccttaaagtttcctatgtccacaattctatgaaacttttcagtggaggtcaccaagtccacttttacagattttctgttatggggagagggcacctcacaacttgctctcagatactgtattcaaaatttcattatcgtcaggaaatatatctcctttaaatcaccaaaccgttcagttgcagttgttctcaatagcctagtcaatttcattcactgaattatagatttccctgattcttaataaatttactaattatactttcctcctaacaccctctgctatgactgtaaaatcactatttataactgataaaatttgccaaactcagtttcctgatgtactcaacgcctctggattttgacatttcttcattttagccacccagtggcaatgccaattcttcaaaagtgtcaactctcagaaattctccacctctgatttgacagtctcaaagatagacaaggactgcctctccacttttttgacaagtgacaaacactgaactgacaactgataaatttgtacctgaatctggtcctcctgtatattctttatttgtccacttctgttgctaggttagagatgaagataatttgtttccacgctgcccagttagtatctgagatggcctgactcttagcattcaaaagtatcactttgctaacaccattctacgtggctagcagataacttttggtctgtgtctcttgtggaaaatccacagaacaagaatagttgtgtcacttatttattaaaaaataggctgggtgcagtggctcatgcctgtaattcttacactttgggaggctgaggcggttggatctcttgagctcaagagtttgagaccagccccgtctctaccagaaatataaaaacttagctgggtgtggtggcccatgcctgtggtctcagctacttgggaggctgaggcaggagaatcccttgaacctgggaggcggaggttgcagtgagctgagatcctgccactgtactccagcctgggccacagagcaagacactgtctcaaaacaaagcaaaacaataagtagtaagcacttactacaaactactagatttattcactattaacaataaaatatacatatatgagtatgcacattatagtgtcatatgtaatgtgtatgaattacaatgccaaaaatttaatgaacattccacttatttattcctctaatccttatactgttttagataatatgtctcttatggtccattttaagctgtttcagattccagcctttgttgattgcttctttgctaatgaccacttactgtcccaattgaactgttcactgcttctctaggagataaaattagagtattttctctttgcatttagctaacagcttaactttcctgaattgaagtaatccctacaatgggtagacagttgaaatattattcgcttagttgatgcctcaaacatgttagctatttttcttttaaaataatatcataacgaaaaggaatatttttaaataacattataccagcccaataaatacatacgtttatatttctgcagcaacatgtttcaagatcaaaacataaacattaaatatatttatgaattactacattaagtatatttttatataactaaggtaaaatgcaattatatgtgacagatatcaaaattaaaatggtttaaaaagacaacttattttcccatataaaaatccatgtctttttaagggtaatactcagaattttcatgtagtatttgtgtctcaatctcatgggacaaaacttatcagcaaatcagattttaaatgtagactttattctaggcatccatgtacttgtcttgaaataggaagttctatgaggaaggactaaagtgttaatggagaatggggggcaactagctgtctctgcctctgatattcatgagatttctgtggtcctattccaaaaacacttggttgacatgctaccacatgtttgatccagaggatataaaaattaatgaaatatggcctttacctggaagattataagcaatttattgtgaaagggggtggtagagcctaggaatgtagtgcagtgaaaactcaggaatggaaatgattaactcagtttggggtggggaggggaaacaaagcatttcagagaagatcaggcacttgtaaatgattttgagtttaattaggaatttttcaggtgaagtatagggtaagatattctaggtggtctgatacacaagaaaacaagctctattatggaatggcacaatctagagaacaggcacaattccacagtggcagcctgtggagtctgcagagggaatgtgggaggagataggtctatagaggcagcttgtggtgtgatgtaaagggccatgtatgtttgaatttcaacgtatggaccagcgtcttgcaacctagggtccataggccatatctggcctgctacctctttttggaaatagttttgttggaacacaatcacatccagttgtttaccttatgtatctatggctgcgttcctgctgcaatggcagacttgagtggttgtgacggaggtggtatgacccacaaagcccaaaatcctttctatctggcccttcacagaaaaaaaaaaaaattgccattcccctcatctgtctcatcaattgttcttggaagctttaaagcagtaggaattcattaatgggagttcttttaaaaaagtgtggagtaacagctcatttattttgaagatcttcatagttttttctgttttgctcttttttaaatctttaatatagactatgcttagaaattagaatgcaaaagaatcagaagaatatacactataaatagtttatttaccaccagtatagaaagctaactaaaaaatgattaaagaatttgccaaaaaggtattaaagaatttgcttaaggagggaaaggaggaccacactttcacagtgaaagcatggatgggctttgcctgctattttaattagtttttgaggctgtctttcatagtctttcacttagaacttattacggtaacattaattattgggaattatattggctgtattcattgtcatgtcaacacaataggaagtgctacagtacacaagtctgggccatgacaactactgaacaactgcagagaacatctgggttagctcaccgtttctagacccagaaatttgtcagttttaagaatgacttcttttcacagccaagtcttcctaggttgtcttaaacttgaagccttttaagtgctcttcatgaagttgtcatacagtatgaatacacaataagcgtcattcattaactctacattaatctgacagacattgtacttcacataattactgcctgctgcattacctttgtcctttgtaagctttaatttcacatgtcaacagcaatcactttagagtgttatatttgtagatacagaaaaaggcttgccatggcaaatatgtacttgaaaggtaagccataaactcttgcacttttgtttgcctcccagcttattatagagttttaatttaattttattttttataatttcaacttttagacttgggggtacatgtgctggtttattacatgagtatattgcaggatgctaaggtttgggatacaaaagatcctgtcacccagtgagcatagtacccaacagttagtcaacctttgtccacctctctccctccccactctgggagtccccagtgtctatcattatcaactttatgtccatgaatgcccagtgtttaggtcctacttacaagtgagaacatggagtatttggttttctgttcctgcattgattcgattaggatgatggcctctagctgcatctatgttgctgcaaaggacgtgatttcattcgttttaaggttacattgtattccacggtgtatgtgtaccacattttatttatccagtctaccggtgatggacacctaggttgattccatgcctttgttactgggaatagagctgtgatgaagatacgagtgcatttatctttttggtggaatgatttattttttggggatatatactcagtaatgggattgttgggtcaaatgggagttctgttttaagttctttgagaaatctccaaacagctttccacagtagctgacctaatttacattcccaccaacagtatgtaagcatttctttttctccacagcctcgccagcatctgttgtttttaactttttaataatagccattctgactgttgtgagatggtatctcattgtggttttgattagcatttctctgatgattagtgatgtagaatattttgtcatgtttattggccacttgtatgtcttctttagagaaatatctgttcatgctctttgcccactttttatgggattatgtgttttgtgctttttgaactgtttaaattttttatacattctggttattagacctttgttagatgcatagtttgcaaatattttctcccattctgtaggttgtctgtttgctctattgatagtttcttttgctgtgcaaaagctccttagtttaattaggtattatagggtcctgcaagcttgagttttacttgtataatttttcctgttatattgttgtaaataagactatttgctattttattaatgaaatataaagcactgtgatctgttattaaataagcagattctattagaacttctatatttttcacaataatttcctatcaattccttaggttttaaatgacagccatactatagaactatttattttgcatattgaagatgtaagctaatttgatgccttcagatgcaggcctgagtctgttttcagtggaactctgttttattaaaaatcatattgaataaatcccttcaagacttactttaaaagcactaccttatagttaaaacatgaaagacaaactggaaaatcagaaaaggggatattattatgaatatgtaaagaattcataaatatattaaataaaaatgtgtatctcaattgaaattaaacaaaaacgtggacattcaatccacaatgtagatataagtagctaataaatatgtgtagagatgcataacttctctggaataaaagaaatacaaattaaaagcacagtgtcgtatttatatttttacttacttgattgtaaaggtgagtgaaacatattagctacagtagtagctagggcacataaaaacataaacactctactgtttataagagcataattcttagtctttctgaaggagtgtttgacaatatatactacatcttaaatgttatactatttacaaacttattttagtaattttgcaggaatttatgctaaggaaatggtagatcaagggcataaagattcatgcataaatttgctcatcatagcattgttgatactgtgaatactagaaacaaccaaagttattatctgctgggaggtggcaaaatgctgtaggatacactcataaaatggatattattcagctactataaatgacaaataaaagtaaaacgtagtttccttttcaagtactcttccctttccttccatcacagcatactttgggttttcttctaatgcctctagattttgcttatctttgaaggcctgttatcccctaactggcattgaaatttggcatttcacaaaattctacccgactcacttcctttgtccagctttctccttcaatcatactttttcaaactgtgggttttgatagaatcttgagacattaaatcaatacagtgggtaataatcaaaattttagaaatgtattaaaaagaaaatagcatgagcaagggtggtgtatttgaagaatttcatgaacttctagaaaactgcattatgttcatttgcacacattctaggacttgagcctggcaggaaaagtaatggagagcattgtatgctgtgagaaatggatagcatttggtcttggaaatgatgaagaaacactgatattttaaggtgaattttattgaagaatgtaatgtactcaatctctttataagcaggaagaacagtgaatattctgcttattggaaatgtatataagacattctaacatatccttagcctaaggtgatatcccagctcatcaatcatctccacaaagactgaacttatgtcagtagtctatcagggcctattagagtagttagccaccataatattgatctttgcacttttagagttgttgcattgataacaattatctttgtctttactatcaaggcaatatccaagagcatgtgtgtctgagtcacagagaagtataaggctcatcttatgttgtacaattataatgtgtaacactggagccacagcatcaaattactataataatcctcatgtctttgggattcaataaaatctgatgttaccttttaaaataattactatcttagactgcttacagtctctgaacttggatgccacatctttcttgaagctgtcttcagaaatcccatgaaagttagtatttcattatgcatccagaagtgttggtctatgctcatagccaaggtccactgcagggatgaggaaagcattctgaatttaaaaacaaaaacttatctgaaaggtctatataaattagttttttcccaagatatttttcatagaagtaaatttagctatgactaagcagtgcataaagcaggtcagtatataattgtcttattttctcataaaaatgacagtgtttccataaattctgaaatgcattaaacacatgctgacttattaagcataatattctgtaatcaaacacataccttctacctattcttgatggttcagagtaaatattgtagtcatgcaaatcataataattccttaaatctctgtaatgtattatagtaaacaggcatatattatttgaatattgtgcaattatatgtttatgttacgaggttcttaaaatagctgaagttatatgacctgacatttaacaaccccatcctgccaacattttgtggtcccgaatcctctttttaattttttctctgcctttcacatcttacaggattttaattttctcttactgctgcaggcaacgtggctccctcaaataatgctctttttcttgtaagaaaaagatcatgacttgtgtgtgtagaagagaagggcattttactaacgtgtcagtctgaagtgtcatctgactcttctttcagccttattggtctgattgcctctcacattacctttctttgttttggaggtatccagagcttggttcttaagaatcagcagaaaaaagaaagtacagaggacaggaaagaatccatagactgagaaagggaaatgtaaagattatacacagtttgacccaattgattattgttttattatatatgcatatacaagttctgactgaaaagacagaggacaaaggggcaggggaattctcggagcatgagaaatggaaataggaggattatacaaggttggatcctttaaaaagtcaatcttacagaaaacgagaaaccagtcaatgaaggaacaaggtaataaagagaaatcttatctccatttatattttgtgaagaccattattaataatatttccccttttttatgtgtacaagtttataatttttaaactcctacctattttccttttattgcctgctgccagtgcctgtcttcctagtgacctttacaagaggatccatgagcagagaaagactaatggaagtatgcccagatagtggcagcaaagatgagcctctggaggccattctttggattcagagaaaaagagctggaggggaggtgacctggaaactaaactaagatccagaagtgaacccagacaattaaatctcacagtgatccctgggtgatttccctaaaaacgtatcagcagcgctgttatttcaagccacttaagcaggaaagcaggccttactctagtacattcctacgctaacgaagagaatttccagtatacaagaatgcagaaatactcaaacattttacagaagagtcatgatagctactttagaatccatttacatttggttatgtcctacttgttattttgtttttgttttttattttccctaccaagagaatggtctcaagtttaatgttgaattaacacttggaataaccattgcatgttcttaccttattgtgctaatgttggacacctcactatatcattttagttgtttgttcagtctcaccataaatatcattgagataatgatgaaagtgcctataaaacacctgagatgcactaggtgttctttaatattagtgatctgcttgcaaataaaacacactgtgttaggcacagtgaaaactattaagatcaattaaaatatagtctatcccttagaaacatctcagtctaatcgggaaaataatataggcatgtagtcatagttaaaatggaaaaatattagataaaactctgatacagtctttttgctttgattttgaaatgaccacccattgctcactcccagttccctcatagcagcccaaaggaatttaccttatcttctttatctggccgggtcaacttctaatacaggtgacttggcctagaaagcctgctgactctcaattttcagatattctgacatgttcccatttggatcagatgagcttggctttctataattgagtcacacagcttaggtgagagttggagactgtaatcccagtttttggaaaagtcaattgttgcatatttccagatgtagataatcctcttgagtatatacctcaatagtaaattaattaatttatttattttagaatttgaacagcaggggtgggggcagcttgaaagagtcttattttaacttgtttttttccccccttgggacacggtctcactgtgttgcccaggttggagggcagtggggcgatctctgtttcactgcaacctccatctcctgggatcaagggattctcccacctcagcctcctgggtagctgggactatgggtgcatgctaccacacagctaaatttgtattttttgtagagatggggtttagccatgttgcccaggctggtctcaaactcctgggctcaagtgatccacccacctcagcctccccaagtgctgggattataggtgtgagccacctcaccaggccatgttttaataccaggccgtctttttaaaaaatcagttttagcacttttatctcaccatattcagtactttaaatcagtcatgtatttgatcatcaggaaatgtactgacaggtaaaaagttgataattaaattttatatcaaattatactacataacaattttatcaattatgtataataattttatgtaagctatataaatgaatttatatagagaaataaatttagagcaaattacaaacatgttcttttatacataaatgcttcagtatgtatttcctaagaacaagaacatccttttacataattcttaaattataaatatcataaaatatataattaaataattacatattaaagtaaattaaaattgtaacttaacatttaatattatgtgtaattaaactatgtaattataaaaatcaagaagtttaacctacagtgtttatataaattttattggttttccctgtaatgtgttttgtaactgttttcttcctaatccacaatccaatccagaatcatttattgcatttagatatcaattctctttattttaccttagtctggaacataacctcagctttctagacctttacattttttgcattatgaagaattataaaatatttgatattttgttccattagcacaatctctagtccagtcccatttagagtcagaattccaaacatcttctaaattaaccctgtcctcttatccatctcaagcctactttggactggatgcctatcatggtaaaggaagaggaagacaacgtcagatagttttctgttctttccctctattgtactttatccttcccctcactgctgtttctttgtcgactaactcttgtttctgacctccttagggttggcagaggggagaggcaggagggagggtgagctacacatcactgttgttgcagtggctggcattgctcatctctgggtttactaagttcaaagaatactctagtggaacatctccacagccttcagagattcctcacaagagcttctggttgcagcagtctctctcctcttgctggcctcttacgacatattctcagcttctgaatgtgatgggtgcatatccatcttctctctgctgatgtttccttgctcccagatgaagctgtctcagtccatcagcatactgcatggccagtattcactcggtccatgggaaacaagcatcttttgctttgttgtctttgaaagcacagttgccttctaatatggctgtttcttttccctcaacagctaagcaggcagttccattaaggttgtcttagaatctttggggactatgagtcaggaacctattgtgcaaactgtgggggacacaaatcaaattttctgaattttgtattgaatcgtctctcttacctgattggaggggaaggaaagcaatcttctcccctccactcccgcaagaagatcagaaaaaaaataccatgccatcattttgactacctcaaagagtggtttaatatttctaatatatgtgttttcttacctttttttttttttttttttccaagacctgattttgccaaatcatttgctcatcttacttggtgggcaaacatttccgttgggaatgtaagagcatgtgccctgctattttggtttctgctttttgggccttctgccaaaactgagacagaggcccttgaaacatccaggatagtgattaaatctagcaagtgcaattaagtaaacatttccagctcctgtcctcctttagagaaaaacaaatgaagaaaaagtttaatttctagagggagattttgtgcatgagcaggactaaatctaataatcccaatagtctggcatatggcatacgtggatattcagtgagaatgtaaaatcatcctgcaagcttttctgtatttatttttggggattgattacaatctctatagtacagtgacttctctacatggattacaggagactgttgtctcagtccacagttcttggaatagtcatatttctgagcaactgattttttttaaccttatggacactgaattgattgtttttcacttgtgataactgctagatctactggagctgagacggtttttcacttctagaaaatgtgcaaaactgcaagacacatgtttggtttacaatttcaacccaggcttttttattttactttttttcatttttctttcttccaatgtcctcacttttttcttgacatgtagacttgtatttaaaaaatgatgtttgggaaaaaagtaatgtatgagtaaataactttattggaaggatagctattaacactttcttttgtatcagagaaggacctcattcccagtttctacatgccttagggatagaatgggatatttttaaagtatgtaaaaggataagtattcttatatatccctttatagtggttggggaatcatttaaaaataaagcaacacaaattggtaattgttaggggattgtcatgtgtttgttttttaagatgagaagttccaaagaaacaagccttatttccttttcgtggtattaaacagctactgccaacagtttatacagagccacaaccatcactgcagctgaccctgaaaacagaaagtgagggccatccattaagaggtccacgactgcactgagtctatgatgcgcaatgtagtggagcagaaatgatgcttgctgcacatttagttgagcctaggagagcagggccctccatagacactagtttgaacattgctaggtttaaaatggtttaaatataagatggaaatctgcacactactagtgtttgtattcatattttttatttggaataacctgtctgtgtatctatgtatctagttgctttagtcttctcatagaattagtataacagttggttatgtataataattatggaaaagggttaatcaaattattacatttttacttgaagcctacatcacagcattacaatggaaagctagactgttactattttgttttcacaagtgtttggtgcatatttgattcatttcagtattgttagaaaattaaactggcattatttttctgatgatgtctcacattgtcgtcactatagaaatgaggctaataatgccagctcattcgaggaatatagcttcaggaatgaattgttttttttttttctttatattgaaatggtagttttttaatagagatactgaatggtgtatttcagatatctttaaaggaacacttaattcagaattgagtgcaaaaaagctgcagaagatcattcatccatgtagatacaattatattgtggtggataatggatttgtgttattcttaatgtctatacatggctacagtaagactgaagttgtttttataacttttcagtacattgaatgaaagaaagtatgacagcagaaaacatctgataaattaaatgtgacatgttttttattcatataaaatggtttctgagcagctggtaattgtgaatatttcagcagtcatttttgatgtggaatacttcttctgtggtaaacactaatgagttgtgagttgtacttcatcaaattgacagtttccttacttttgtaaataggcatttgatacaccttgtaaaagctggtaaaagacactcaactcaccttttaaatgcatagaattttccccttattctctttctacattgtgccatccacttttcctataaggaagataatgcaaagaaaggctaccattcactgggagcttaaaaaattcccagaatcattctgggtaccataatatacactatccattcataattcttacagctcaaattagctcaaaggaaaaactaagactgtacattggctgggagagtaaacgagtgcaccaagaaattacccgtactcaggttttgtaaagtgtcttaatgtgaaatagttgtgtttcttgttattttaaatactaggtatttttagagaatgagataccttacattcctccatcttaaaaaaaaaactttatttataataatcctgtaaaataggaatttgatgtactattctcattttataggtaagagaaattacatagagatgaatgttagtcacagagtgggaccatagtgcagactcctgttctttaatatattgtattgtttttacttagagaaataaattaattgtactagggacatgaaagaacatagaataagaattgtccgaagagaactaaagatgttaagattaattaatcaggaagtatattttaacaaatctaagaggataaaattagctgtggtactgcaattaaaaaaaaaaaaaaacctcttgaaacagattgagtattattaacaagattaacccaactcattctttggggagggaacattatatattaagagctctcttaaaacatgaataatgctacatattttgagtggaagtgtaacttagtgctcaactagcacagctgaattagtacagctgctgctagactttcaaatcaaacagccctctttggtcttttttataccttggtattgtatataatatttctgtgagtaaagagttctgatactaacacattgtctgacatagtcatccatattttaatgtaaattacactgataataatttagaataccactaatagacatgatagtgatagcatcttatgcttttacagaatattattattttccaaaagagttttattttgatggttctgccaatatgtcaaaatcagtaacctgcaatcccttcaaaaacaagtgtatagaaattttaaaaatataacaaacctattttataaaggcataaataagttcacaaaatataagaggtatcctcagaaaccaaatacgaacaagtcaccaaaagtcagggtggcgcagacatgatctgacgatggggttaactagagctaaggggattggggtcaatgttctcagtccagaggtttgtgatgtcccatttgtacacatgagcaaatttacatcttagttttttgcataaattggaaccaccaagagactgcatgtaacctagatgtactagaacaggggtccacaatgccctggccatgaaccagtaccagtttgtggcctgttgggaaccaggctgcacagtgggagatgagtaacaggcaaaccagtgaagcttcatctgtatttgcagccactcccaattcctcgcattaccacctgagctctgcctcctgtcagattaatggcaggattagattctcataggagcatgaatcctattgtaggttgtgcactccttatgaaaatctaatgcctgatgttctgtcattgtctcccagatgggaccatctagttgcaggaaaacaagctgtgggctcccactgattctacattatggtgaattgtagaactattttattatatattacaatgtaataataatagaaataaagtgtacaacacatgtaatgttcttgaattatcctgaaagcaccccaccccccagtttgtggaaaaatggtcttctgcaaaaccagtccctgttacaaaaaagcttagggactgctggactcgaaaacatttcccccgtaagcatagggatgtgacagaaaaatttgcagtaagctgaaatcgacctatgcctcttcctagttctgctcacaagacaacttagtacgaaatctagtgcttcctccatgagttgttctttcattttatgaggacagttatgtgatatggtttggctgtgtccccacccaaatctcatcttgaagtgtagcttctataatccccacatgtcatgggagggacccaatggaaggtaatttaatcatggggatgggtttttcccatgctgttcccgtgatagtgaataattctcatgagatctgatggttttataaaggacagttctcttgcacatgctctcttgcctgccatcatgcaggacagggctttgctcctcctttgcctttcaccgtgattgtgagacctccccagccatgtgaaactgtgtgtccattaaacctctttttctttattaaattacctagtctcaggtatttcttcatagcagtatgaaaatggactaatacatcaggtctttgctaggtcttgccttttctaaactaaacttaaaaaaagtagtaagaacacagtgtaagatctactcacttgatttttaagtgtaaaatacagtgttattaactgtgggtacagtgttgtacagcagatctctggaacttaatcatcttacataactgaaacaccatatccattgaactgcaactccccatttcccttcctgctaacccttggtaaccactattctactctttatttaaaagactttgactattttagatacttcatgtaagtggaaccatgcagtatctattcttctgttactgacttattttacttggcataatgtcctccaggttcatccatgtcatcacatttggcaggattcccctcctttttaaggctgaataaattccatcactattcaagtcactattttaagacgaaaaaatcaattgcttgtatataatacattttttaaattcattcatcagtgggtagttaaggtgtttccatatcttggctgttttaaatgatgctgcaatgtgcatgggagtgcagatatctcttctagaccctgatttcaaatctttcagatatatatccagaagtagaattgctgaattatattgtaattctatttttaagtcttttggaattgctatactgtttgtatacaggccacaccattttacattcctaccaatactgtataatggttccagtttttccataattttgcaagtatttgttgttatttttggtaataatagccattctaacaggtgtgagatgatatctcattgtggttttgatttacgtttccctaatgattagtggtatggagcatcttttcatatgcttgttgaccatttgtatgtcatctttggagaaatgtctattccagttcttcctgttttctaaccaggtgattttttttttttttttttgccattgatttgtaggagttttataattttggctattaactatttatcagataagtggtttgccaatgagagactaaatattaccattttatttaaatattatgtgcacagtcattagtattacaatattatattccccttgctcttaactgggtgaagcgtgcaggttaacatgtgaaattctgtgctcaaattctagttctttgaatctagtttccctgattttaaaattgagaggattgctacctgagacataaacaagattaggaagcatgtaaccccttagcccctgatacatagtaaatacttaacaatttccttcttaaaatgattatttttctataatgtatcggtatcgcatttatatatctacaattctgttataacataccatttgtttacaaactaatttaaattgcccttgaaaaagttaaccatatataaataagttaattcagaagaatgactgcttgttttatttaaaatttaaaacattcctaataatagaaatacatcattcttgaaaatatgcccatagaacccatagaagcttcttatgtaaggattttgtttgaaaatatcaatgtgaaccagctgtaaagataaccattgtacagatacatttcacccatctagaagtcactattcaagtcactattccaaagtaatcaatatctatcatttgagagttatggagaatttcccatatgtagaatgtaatagacaaaagtagctcatacctcataaaattgtgataaggaggatttaattaggttgcacatgataacctagtgtaactaacacagaggatagcccatagtaaagattagatgcattattatcatttgcattatgataaaataggcaagaaaaaatattgttaataagactggactgacaagataaatgaaatatgaacacacacatacactaaagttgatgaaattcatttatgggagaaccaaacctttacttagggaactgtaattcagaaaataaaaaggacaaaaagagcagaatctattaatgtcagtcaagttcacagcagcaaaaattgttaacaatgccttaacagtgagtgagggtacagagcatcgttcaatatatatatatatatataaaactcaaaaagtgtggtcctcccaaatcatttaatatgagaacagccaggcctacacacattaatcgtctgtgaaggcatcagcacagtccaccatagggccaaattgatgtctatggtttttattttctgggataacagaggaatatataatacactgaacagaaaatgaaaattgagcaaaccaaaagctttggtgcttgaagaagcgaatttctattatctagaaaaatcactgaagtaggtgtttctttccaaatgatgatggataagccaagcatttctataattgcatactgaacagataaatgtttgacctaggcttcatatgccaattactcctagatgtggtacagtgggatccagctagccaaggtaatgcagattaatatcatgtcacttctgcatgcctgggtaatatgttgtttcatcagatggtgctttaccttggcttcctttggtgtatgaacatattacagcagaagaaaatggtctgggtgggaaaatctgatgaagcaggtgatgtaaactgtctgtaatcactaaatataatgagtggacaagtagaactcctgttaggcctctagcttttcctactgtttggaacttgaatcaaaagtcataatagaattatgccaatctttcctatttttaaagtgcacagaaattctgcaaagtaatatgatacttagacactgaccatttggtaggcagcacagaagtaaagaagtcactcttcattcaaagtggatcacagcattaacagctgtgattcttgctattaaagaataatttttatcaaaggagtatattttaaagatttagttctataggttacttctctatgaaaatttaaagaaaatccttccacagagaggtatggaggatatttactgtcaataggtttatactattaatgagttatattcatagtggtatgaaatattagttatgtcagcttcttacaattcatgggacttttgcagaccttcagaaatgcagataagcattgctctgctcactttgaatatcggatacatcctccttgcactttgaaaagcaaatagaatacatacatttatcaatgctgacattgatacctttctacatagctcagcaaagaatcatccaaataatacaaaattgaaaaactggaaggctaaacaaaataagccgtcttatattttacagttgaaatacttagatgtaagtgaattaagtaattctacccctatataaagtgatattttttcctcctcttaattctttctttcaggaagaagcacagataaacagaaggctaacacaatatgatttatttatttatttatttattttatttcatttttttaagaaaaggtctcactctgccacccagactggagtacagtggtgcaatcatggctcactgcaacctcaacctccagggctgaaccattcctcctgcctcagcctcccaagtagctgggactatcagcatgagccaccacactgggctaatttttgttgtttttgtaaagatgaggtttaatcatgtttcccaggttggtcttgaactcctgagctcaagagtttttttgtttgtttgtttgtttttttttttaacaattgaaaacgaaacagaaataacttatataaaagtttaaagataactggatatgacctgcggtgatatatggcaattgttttactgattatgtttagaaaaatccccaacgtgttcaatttcatattaaaatgcctagtatttatggtttataattatcatttttagtgcaatcttgcgcaacaggaatttcattttttataaagttatttgtcacagtgggaggatttgttttctctttagtttatattttataacaattgcaacccatgatttcacagaggagactatgattaggtataatacagattaacctattaagaaatacttgtaaatcttacaattgatcaagattattttgttatgcaaaaaaatagaaaattttattattattgaaagtgctatcatcatacctttaaactttataattgtatgtatttttcctttattcaaggaagattatttaaagtagtgtaacatacctacatactttcaggagctgggcagcgacataagtgaataaatgagtctgttggggaaggtgtaggatgattgcattaacctgcttttagtttgacatagtaacacctacctcattatatttactttcttattctgggggtgtgtttgtttcgatttaatttaattttttgtaatttattgtgactaattgtggggtacagagttatgatatatgtatgcagtgtggaataattaaatcacactaacatatctatcatcttaaatattaattatttaatctctcaattgcaactttccaccctttgataacattatcccatcccaattcccatccccttaccaccaatctaccctctgctactatgagttcaacttttttagattcctcatatcagtgagatgagtggtatttgtctttatgtccttggcttatttcactcaacataatgtcttccaggttcattcatgttgttgcaaattatagaatttccttcttttttcaaggctgagtaatattacattgagcttacaaaccacattttctttatccattcatccactgatggacacaggttgatttcagatagtggcttttgtaaataatgctggagtgaacatgggagtagatatctttttaattcctcatgatatatacaccaaagtgggattgctggatcatatgataattctagtttcagtttttctttctttctctttttttttttttttaggaacttccatacagtttcccataatggccatactattttacactctcaccaacagtgtgcaagggttccctttctttacattgttacacatctgggagacaaacagaacatgtttatggggtgtagtgggcctcagaaagtcaccaactatagcctcctctattacgttactcagtaagatagatgctcccagggagatgttaggtcaatggtatctgccaacttttcattagaaagtattaccctcccctcacaaaggcagtttagaaatacttcatcatggaagtgaaataaaatgctgtcataatttctctactatgacatatctacctcagtctcttcctgttcaatccatatacacattacccttgccccagggttatctttagatacatgagtctttttatgtattctgtaagtagttaatggatttaattcaatgaaatgatatcaccttcaaaagaaaatctaaactcttagactattactaaagcagcctttgggaagaccctccagcatctccctctcattttcatttctccctgtctaccttccttcacgccctaatatatagaaacacatctcattcacttccccactaatgtaaattgagcaccacaaagaagtcaggcactatgctagatacaagtgttaaatatgagtgaacgagaaagacttcatcctactcttggggagcttcacagaggctagtggggttgacagatattaatcaaataattatgatgcatgccgtggaaaagtttaggtaccatggactgtgcatcagttttccaagttgctttttactattttactcatacctgccctttccatctgtgaaaccttcactcaaccctccaatcctcgttgatttacctccttgggacaattattataacttgtatgcatttctcttattcaaaattatcctaatgaaatgggttgcttggttgcttatatgttttcacatgagcaattgctctattttctcttcctttgcagatatagcccttggcgaggtgcctggctccatagtaagtgttcaacaaatgtttgaataaaatattgcattgttgaattttaaatgtatttaagcaaattgataaccaacatctgaccagatttcccaaatttagatgcaatgtcagatgcttcttttaatggtgtcagagattggctgacaggcttgcctgtctttaaagtaatttattacccatgttggttttttggtataaatggttactgtttgtcattggagtatgtttgtattcatggtagagattaaatacatatgtattgcatgaattaacaaatggttatgctagttgtaggaaagattgataagtgaaagtttctaatgctctttttttgagatggagtctcactctgtcacccaggctggagtgcagtggtgctatcttggccaattgcaaccttcgcctcctgggttcaagtgattcttgtgcctcagcctcccaagtagatagaagtacaggtgtgtgccaccatgtccagctaatttttgtagttttagtagagacagggtttcgccatgttggccaggctggtctcaaactcctaatttcaggtgatctgcccatcttagcctcccaaagtctaatgttctttacaggcctatgagtattttatgccagaatattgattttattggagaactaaaaattgatacaatccatagcttgaaagtaaaaatgtcaaaatacttaagaccatacacaaataagtattctaaaataaggaattgatatttataaaatatttttaagaaataaggacatttggccaggcacggtggttcacacctgtaatctcagcactttggaaggctgaggcaggtgcatcataaggtcaggagttcaagacctgcccggccaatgtggtgaaacctcgtccctactaaaaatacaaaaaaacttagccaggcttggtaacaggtgcctgtaaacccagctacctgggaggctgaggcaggagaatcacttgaacctgggaggcagaggttgcagtgagctgagatcatgccactgcactccagcctgggtgacagagcaatttaaaaaaaaagaaataaacacatttaccattacagtattttttagccccccaatcttgttattattaataacaataataaaataataagcccttgacttctttactttgctgtccttttcatttattttgcatttcttcattttccttgtgcagattttatactctgctatcctcagccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacatgctctcctcttgttcttatcccttttataataagcaaattttttacctccaagactccagaagattcatttataggtctacccagccatggcctctctaaactgcaaaggatgtggactgtttagaaaaggggaaagagatcatcacaattagcttagaacagttgttctcaactctattagacaccaactcttttgattagtaatctgaaatgaaatttacagatgtaatttacctacacacataacctaacaagaaaaaatgttatgctctctttgtcataacacagtaaaataaaagaatatgtaaacatttgggccagattcaaattgaggtaattggattcttgcaaatatatatatagaataatagagtaaatagtgtttgcagcaatatatggaatcacaacaaacacagcagcagtgatgcagactgatatatttttgctgtaagggcgtcacaaacataatgagtccagttactgttgctttctctaaaatactggacaactcttggtaacattccgattaagacaatgtataatgtttcctgattaatattttacttgcaatcctgctgcacattggaaagtggtaggaaatgcagaacaattatttgataacacacttatgtcccttcacattgtaggatgacacttcttagacctcgctaacaaatgccagtaatatccccaatcattgtgacaagcaaatttccaggaaaaaaaggtataatttacatactatacatcagaatagaaatgtaagatcaactgaaagcaaagaaagattgatttccttgattttgagtggcatctcatgcattcccacttactgcctatagctgttacagacattcattacaaagttaaattaaaggttactctgtaataatttctcattatatgccaagccctaaaagaatctaatgaattctgtctaggataacactaattgtaaggttaaagtttcctggggaaatcttgcctggtaccttaggcactggggaaatgtatgctagtgatttcaaagtgaattaagaaacaagtttttaatccgtcttttcaagaattttaatgaaatacctagtttgtatctttagaattctagaaaagtacctcatcattttagactgtttccttttaaatcattggcatctataggctaccatcctcttgaactagatagattttaacctttttccttattcattctaatttagcttgtcgtatatatataaatatatatatttatatatttatatatattttgatagtggctatttgctcattaaaaatcaaaagttaaaagtaattaatctcaaaaaatggttaactggcttacctgagaaaaaataaatttagttggtaaaggctgatttaattaaagtttatatgttttacatttcctttgctccatgatggaaataagtatttttctttatgatgtggttcgccatctacatgaacattttaataagagaaagcaaaataattttgaagaatacattagtatttgtaggagccattcatactgctttctgcatttaaggtaaattagaattattcactaagtcaaataatgtcaagtagaaaacagaaatagatgttgatgaatgaattaaatatgattaggcatattttattcattgtttttttcattttgaactttttaatgaagtcattgaaataccaagtcatggtcataaaatttcttaattcctcttaaaaaattaatttaataataaacagtcatttaattagtttataaagcaaaattgaaacactttgagtataggacttaatagtggaatttagagagttccccagaactcttcttagcttttaggctcttagaagataaaattgtgtgtctgtgtgtgtgcacatgcaataaaacaataaaatggcctactaggaatacatgaaacgatgttgtttattgttgtgatgtttcagataagggaatataaagtaagattgattagtaaaagatgaaagaagagattagtgaatgatggattagtaaatgatgagcgtggttttgagcaggggcttgaagaaatgatgggtatgtgaagcctagaatactgatatgaaattacatgctgagaagaatatggagaaaataaggcactcctgaagtgcatatgtgagaagaatggcttaactgcactggtgaaactgtgttaatgaggaattgaaaattgcttagttagaaatagaaatgttgagagaatgaagaggttgttgatttaatgtcttagatgtggataacaaaaatgaaagactcttgcagagattctttaggccctagcattataagaactatatgtgaggtagtatttgtagtagcttattggagaagtgcagagttggaaggatccagaacatatgtaaaattgctgagtactttacgcattaggtgatgaagaactagatgattaaattgatggcaaatacttaaatataaatatgtatacataaatatagaaatatatttatgaacctggtaatgacaaattgaaaagtatacacacatgcaccacaaagtatttaaccatatgaatccattttactaaaattgaattaaagaaaatattatttctccccattatttcacagtatgtaaccctaattttattttctttgggaacagggtgggggtttggagggactttgaactataggtatttaaattattttgagagcttttttttttttaaagaacaaacaaaaattttcattattgaatgctattatcttttaggtttctactgaattagcataaaccacttttgttaagttaaccatctatccttgtgaagtgactagaatgaagggttaatgatatacttgcagggtcaaagataaatttgttgtaagaaagtaagacaatattctgtttataatatatttgtatatatagatttaatatttaaaccattaatatccttagctatcttcagtaatgctttctttcacttttaaaaaagaagtattttagtcatgtctaataatcatatctgtacatgttctttgtctaatcactttgaaaatacctatttaactaaaatcactgtagaataaaacaaagatcagactttcctcgtttgtatataataaattaatgcttttaaaatctgaattaactcctgcagtaacaaggcatgctctgagaggaaaatgaaaagtccttaattctaaatttaataatttgcaaatataatctctactaaacaattttgcatgtatacctactagacctgccctgtgttattcaatagccactagccacacatggctttttatatttaaattaatgaaaatgaaatacaattaaaaatatcatgttttttttttttttcttttaactttttttcttttgagacagaatctcactctgttgcccaggctggagtgcagtggtgtaatcttggctcactacaaatctcatgcctcagcctcccaagtagctagaactacaggcatgcaccagcacgcctggctaatttttgtatttttagtaaagatggggttttgccatgttgcccaggctggtcttgaattcatggccttaagtcatccgcccacattggccttccaaagtgctgggattacaggcatgagccaccatacctggccatgcgttcatttcttgctgtggagcacaaagtgttacttgagtatcctttgaactttttagagattactttttgcagctaatgctagaattttgaaaccccagacctttgtcaaccatcaagaaatatagttgatgctaagtaagcacttgtgctggacaataaatgtgaacattttgtattaacccaataaatgttgtcttgaatcttacaagagatgtatccacttacaaacttcttacttataaatgacattgaagtgtttaagaactttacttctagtgagaaagacactgaaaagttcaagaaagttctaatgtgttattcattccaatgaatatcgaagattaatgaataaggcaattaagtaagcattccttcttaatcttgactacaggtaagacaagaggaagcagggggcacaaggatactgtagaaaaggaaattttacttagatatgaagaaatgtttcctggtgtggaaaggaattgcacattggaaggatttattgagtgaggttgtaggatttggggaaatccttaaaaatagaatacatttcaatctctctagggaggtatgtgatatgcctgcaggcattgagtgtggggatgaattagattcattgtcatggttttctcacaccaacaattctatgaatctatagaggacaataaaattggataattctcactgtgttcttcagggagtcaggtttccagactgatttttctagcagtgaatcaggcccaaaatattaccttacattcaacaacttttcaaatgcagtaaagaaaaaaaaaaaaaaagaaaaataagaaatgccagcactttgccattttaagaatcagtgtttcttgagatggattagtatttcctcttctttagtaagaatgaaatgatttgggtctgagtgtaagcactactattggaaggaaaatcttaaattcctattatatagctgagtttaagggaaaatgaatttagtgtgatttgaaaatacatatgaaataatgaattttgcctttaatctgaacagtaaaattagtttcacatgtgataagctctagttgccattttgagaatgttccattagaattacacaagtttggtgtttcagcctcctggaatttgttccagcactccaatattcaagcccttggctgtgctggaaatgaggcagcaggcactcaggtcagagctgcaggcaaccagggatttgggaagtggcccaaatgcactcactggagaggcattggaagaaattgtacagagaagaaactgggacaacagacctgagcatgctgctgtggaggatggggtggctacatcagagttgcagtgaatctagtcacatattatttacatcaaagaagaaatcctaagccataattcatctgaaaagccaatggctgaagtttttgtttttaatctagtgatgtaattcttcgccaggtttaaaatggaaagcagaagcaggtcaagctgagtcatacacacaaggccaaatgtggggaaagcaggaatcaaaggctggaggtaggggaaattctaaatctgcagagcaccatctttgagaaaaagaaaaagaataaaaacctatactggaaggagaacaatcacgaagagaactggtgggtgaagaagttgagataaattgtgcaagccttcactagagataatgtccttttgataggccggttggtgtagtagaagaagcccctgttttagagtgagaagtttattttcacatgctggctgtgagactttgagcaaaatactgaatctctgctccttcatctgtaaaattcccataataattcttattttccaggttgctgtatttcaaaactgagcagccactgtacctgatatgcagtagaaaattaataactagtagtcactgttattttgttgacttttcagtgggtagtggagtgttcttagcatttattcattcttcattcattcagtaaacatttattaaatatacacagaataccagagagtactagaaacagaccacaatcaggagtagttcattagttcttaaattgccttaccatggttaaactatctttagaatatggatcactagcagcagagtatcagcattatactagcaatagagagggaggcaccaagattgaagtgaattgaagagaggaattgcatctgagttgggcaatttttcttatgggatcataggggtttcagatatctcagcatctgatgtgtccctctagagcaggggtcctcaacctctgggctgcagacccatatcagttcctggcctgttaggaactgggtggcacagcaggaggcaagcgagcattacccactgagctctgcctcgtgtgagatcagtggcattagattctcacagaagcgtgaaccctgttgtgaactgcacatgcgagggatccaggttgcacactccttatgagaatctaactaatgcctgattagttaatgatcatctgaggtgaaacacttttatcccaaaaatcatctccccaacccctagtccatagaaaaattgtctttcaggaaaccagtccctggtgtaaaaaatttggagaccactgctctggagggatttctttatctttgggaacagcaccttggctagtcccacaggatttgagaatatattgaaggctttcttatttaaaaaaattataatttgagtagaaaaatagaagaaccacaatgtgtggtttagactaagggatttatgattgggattaaaccttatacaattgcaggacacagtggggaaataagtgtctgaaagggggagattgaaggatcagaaacacacacacacacatacacacatgaacttaaggatcatgaagaggaacttatgaagaattatggaaagctgtcaccacgcttttggtgatgggcatgaagttattgtaggtgctctgggcagctggatataagacaaggcaaagacaaacttggacccatgaggacaaactgggactgatgagcacaaacaagaaaccttgagaaaatactcaaagcccctacaacaaactggaagccatgtctgtgtctcatttcttctaatcgcagtgatgttggccacctgcagaaaaatctggtctcttcatcagggatctgcataggcacatgacccaggactcagaaacagaagggagatggggaaaaggggagtttggattaactaccagtttggctgctttgtcacaccaatgaggtaaaccttcagatgagtgacaatgtgagtgatgtgcgatgggtaatgccttatctctgccttccataaacagtgcatatttctttatgatcaacaacctaataccacacaggaaagggagttctggagaatttgcctaatttactttttagcttagctatgttgacactgcaaaatcactcccaagaagagagaagagatttgatattattcttataagggagcattggcctttgatctaactctttctgctttggcaattctcagagaggtatgaggaggggttgggaagcgtaaaaacggatgaataaggaaggcatcccaggatcatgctggggacattttccagctgatcacctctattctgttgcttcatctccctgaaccctgcaattttgattacagtttctttagaggatgaatacacaccccgctgctgctgaagaatcatagcatagcaagtcaccaatactggtgtaaaagcagtcattcccttaggtgtatctatgtgcaataaagctgagaaccactgatttatatactgtagtagcttttgtatgtttgtttttaccaatgtattcttgactccttaaagacaggcatgcctacctattgttctacaactcaagttacctatagtcttgttatgcagtatctctcagtttgcaaacttaggtatccccaagggccagacataaaccacaaatgttagaccaaaaaagatggtgggattgaggattacatctggagcatgcattgcctaacctaatgccattcaaatgagagaagagaggcatcaaccatcgcttctgacaaaatgagggaggctgccattttcatataaatagctcgcttttcttactagtaatataagattcacttggtataattctattaaggaatcaattataaattatactgtgaccggcaaatggtgttcataaacaatgcagatatttatctgctttgacaataaccctctgatagaaactaaaaacattttaatatttcaatgaagtagcaaatgacctactaaaaatgttctttattgaaatttattggcataagttggaagaaagaaaagaggtatattagcttattcttattcttagcttattctttcacctaaaattataaaatataaaaagtttaataacatgaaaagtatgaccatgatttaatataaaacatctactgctatgattgaattactgaaagagaaaataatactgaattatgtgtgtaaaagttgtgtatattatgataaaaactcatgattcattaacactaagttataaatcatcacatagcattttttaaaattttacaaacagtactgtttaggagagtatattctacactagtttttcagttcaacatcttttcataattgttcagcttaagcttttcaattgttgctaatgtgttacatcacaaaattagttgaacacattttaagagaaaggaatatatgatttagaaaagtttaccttcaatgaggtatagaagtttagagatagttattttcagcttcaaataaatagttttgaatttttttttacttgctaaacatcccttccatgcattttgttgcataaatatcctatgggaatgatagacgctattaaatagtcaacaaagcaagaatgacaactggtacatggttggttctttgaactgtttattaaatgagcaaatcaatgaatgaataataaatgaaaaattttcactcttggactatttacctggttttcttaatagtaaattactagtcagttatgtaaaataaataggtgtttgggcactcttgggcatacatgtatgatacattttatattttctagaaggttccaccagtcttctcttacatattgaagacacaaatatttcactcatatattcacccagtatctttctcatttccagctaaacatgtttttccttttcaaattgtgttaatgacctataagtgagtcctcatctataggatgaaccaaatttacagtgttgcaaaactaatgttggccataaaaatcaatacattgactacaatctataaactatttataaaagaattgatgttcgtaattataactcaatttatataataaaaggataaaaatgaacaactaaaaggaaattactggcagcactgccactgatatctagcactaccactgatagtgtctagaaaattgaagcaaatgtattttatgaaagcagtgagttacttagaatggaagaagaataaagttttaaggtttggtgaatctatgtgctaactcaatactgatatcatattaatcaaggttcttggatacagacaacagaaggcagttatgggttttactcagaaaatgaattttttagaaggaaatggttagtacatagaattgaaggaaatgctggaagattggcagaaaccacagaattagaaatggttaagaacctaaagcatctacttagccaaattgtgctcttggaatagtagctaggaggtccctgctgctggtactagaccacacactgaccgcatggacacgttggcattggctgccactcatagatgcttcactgtagcttctgttgtaatcagttctgaactgttcttaattctttgtatcacttgctctagattcatggtcccagatgatatcatccagttgtttaactgggtcacatgtttatgctctgttgtctggtgccagagagagagagagcaattaactgtaattttcagattctgctgtggaagggaggaccctacctctaataaaaacatgtaagaagatgatctcccaaaattggaagggaatatgtatgcatcaaaatgactaatgagcactaacgccattaaaacgttgtatgacctaagagggcaaattattcaacctttctagatatcagtttttaaatgtgcaaaacaaagattgagaaatggataagatctacctctaaaataactaatttgcagtttagttagaaagataatataagcactctgtaaacaacagctacaactaccaaagatctgcagtagtgggagtgaaaatgaaatatcagagatggaaaaggatgtttaaaaggtggctggaggccgagtgcggtggccacgcctatgatcccagccctttgggaggctgaggagggcagatcatgaggtcaggggatcgagaccatcctggccaacatggtcaaacctcgtctctgctaaaaatacaaaatttagttggatgtggtggcttgtgcaggtaatcccagctacttgggaggctgaggcaagagaatcgcttgaacccaaggagttgagccaagatcacaccactgcactccagcctggaggcagagtgagatttttgtctcaaaaaaaaaaaaaaaaaaaaaaaaaaaagggtatcctgggagtttgtcagtctgcatctgtacaacatgtgctgttcacacaatatacaaacacatgataacagctggatactattcctgtcaaatcagattttcacaacagtggcaaaggattaagatgattggagaatagtaggaaatagcctctatatgacctaacatactaatatcttaggttatttaagacagatgagaggacaaactgtaccgtggtgttcggggaaaaaaaacactccgtagaaattctcttgaaaacaaagccacctacatactacatagcaattttagagaaatatgtctcattttcattttcttttttcttttgttttcttttttcttttttttttttttgagatggaatctcactctgtcacccaggctggagtgcagtggcacaatctccgctcactgcaacctctgcctcccaggctcaagcgattctcctgcctcagcctcccgagtaactgggatgctgggattacaagtgcctgccatcctgcccaactaatttttgtatttttttttttttttttttttttttttttttttttttttttttttttttttagtagaggcagggtttcaccatgctggctaggctggtttcaaactcttgacctcaagtgatctgcctgccttagcctcccaaagtgctagaattaacaggcatgagccactagcgcagcctcattttcttataataccattatatgttgtttgataatttttcatatctttcaataaggtttatatctgtcaggaaaaatcactattttttcaggtgcctcacaaaattcaaaggctaggaaaagcatagaccttttctataatttttgagaatatattgatttctgtgaattgtgtcacaagacatagcaatctctcccatacttttcttccattaagaaataacacttttatagtatctttcatcccagaccacttgagtgttattagaatttcaccctgtccttttgctttatctcattattataggtaagatatcctagcaaataagtaatattaaaaggcctcaaatcacagtggactggaattttaaaaagctatatcccattgatttaaagtttagaaaaatgattccagatctatgctgtcacttattctctgagcttaaaaaaagtcaccttttccttcctttttaaattttctcatgtggtaatgagggaatgtcttaaatggttctaagatcactctgatttctaaaactatgtgattctatcataccactgtacttcaacaagtctccaactcgtgatacacgcagaagtttcattgagttgatgtttcttgatgtatttcactcttctgctgagaatttgtaactgaaaaacgaaataagtcaaatatataagaaacataaaaagtacatgtatctatttagatatgtgcaagcgctattctctccctctttctcaaagagaaagaagtctagatacagaaagatgtgtatattacaaacgtagtttaaaattttacatataatttatttgtagggatacttagttatgtgataatgtactattataattttgatgcacaaaattatatctaaaatgcttagacatatgttttggaatttataattagaaaaataatatagtgcatataccatgttttacgcaacactcccagtagcatttggtcagtgtattagtctgctttcaggctgctgataaagatatacctgagactggccaatttacaaaagaaagaggtttaatggactcacagttccacgtagctggggaggcctcacaatcatggtggaaggtgaaaggcacgtctcacgtggcagcagacaagataagagaacttgtgcagggaaatttactcccccttataaagccatcagatcttctgagacttattcattatcatgagaatagcatgggaaagacccaccaccatgattcagttatctcccaccaggtccctcccacaacatgtgggaattatgggagctacaattcaagatgagatatgggtggggacacaaccaaaccatatcagtcagcaacccataatcaaagaaattaacagttatacactgaaataaacttagtattcataaataaacaaaactacaataattccccatcaacttcatggcaagtttgtctggcacgttagtttagatcaggtcaagtttttccatcgcatgaattaggaaacaaagcttttaactttaaaaaggttttaggcttgagctatatgcataagggattttgaacctatgaatacatgatttgtctgaccagaaactagtcttttgggaaagagtttttgagcttgcttctgttctagacatgtattttgtactgaagtttatcgctgtcctcaggccacaccctcccctggacacagtggagagcagccctgattatttactgagcagtgctcacactgtcctcttgaaatccaataaattcttgacaagaaaactggcatcaaacttaacaattacagtggaaaaaactagtatttatttatttatttatttatttatttatttaacttgataaaggtcaaaagaaagagatatagacaagcctctgcaggaaactgtggtaattttctgtcaataaatacctcagactgaaagtcttggttctgcagattgtttctcctctctgactgtgaattctctcttcaacccagttaagttgtttcctacttctgagctgaatttaaaggagacatgaaggacattcaaagagcttcaggggggtaggttgtggaagacattactaggaggatttcttccccctttaatcattggctttacttttcattgaaacatgttacttttaaacttaaaaacaacccagcattttaatgctgcaaatgaactagctgaattacttattctgaaagaataaggaaaataaatgatactagtgaataaagaatacctagctctcacagaatgctttagtttaagtagttataggaaagtgctctccaattgcagtatattagcctatagcaaaccattaaaaattcttacgaatttttttcttcccaaagaaaactatttaggcatcaaatcagttaatataatgaattaaaacagaacatcactttggtggcacagtttcaaaacagacggattagagacattcagatactgaacatgcaacaccagctatgatttcagcagggagtcttatttggcctttgttcatcttaattccatcaatttcaaatgttattaacaacaatgggacacaattccaacagtgatgctttacacagccacgtaaattttgaataattttagtccttgcaccattttgtttctaagggcaggtatacaatttttgttctaggatgtattaaaataaccagtatttcttccagtgagcattgaagaattaagctgtaaaagacaataaatatttagttttagtgtttacaggggaactactactacttacctgatttaacttagttatgagtaaaaatttggataggaagactaagatgagcatcctaacctactgaacctgctgctaaagtaacaggattgtcaagaataagaagttattaattttaacgtaaatgaaaagtagttttagagtagttagaacatgggaaattttacatacaaccacacacacacacacacacacatatacacaaccatacacacataaagtgttttgtgcttgggtgtaaactaatcatgagtctgttaaacggggaaccatatgatatgttcagtaaaattagtatgttagaatggtaagagtcagaaacaggaacaaagaaaaggaaaatacgagagcagcagaaaaaggcagtgtgcagcaagtgaatggcaatgtaaaatctgcagtaaagctaggtggaagtgtttagaatctgagtaattacacaaactacagatgtttaggtggtcagaaatattttcaggtcgtataaatgtgcaagtttgtagaagcctggaaacagaatgagggtatttcaatttattcactttgtggaagcaggaggtgagggtcactatgtgggcagtatatatagctgccttagattgtcagaggttgcaaaattgcattgttccagaaaagtgagacaaagacagtttcattaataagattattatgataataataatgttacccataataatttttacccatctctgggtaaaaatcctcaaagagtggtagtgctgaaattaaagaactgagcaaacacagcctggcctatgatgtgagcgagagtaagaattaattgtgctacttccttatccttataaccccatcctcttgctcctcctcacggaagccccaatgacaacccctgtagaagcagattcattacatccacattcactcagtatttactctgtcaagacctgagctaagcacattcatatatttaatattatctgaggaaattaatttgtgataacaggcattgctattattttacttttcactatgaaacagatatacagcaatatccgaggaagattttaaaagatttttagtataacgtatttcgtgatgcacggtgacattctgcgtctctcactctttctccgtcacaaaaaaagccacaacaaaaaactacttggaacttacttcctccttgtatttctgcattgaattccttatgattgtgagagtaacatcatagataaaatgaaataatgtttaacctatggagcacaagtttattaaaaatagggaataaatttatgattatcacacacacacacacacacacacacacacacacagaaagagagagagagagaagggggcaggaaaattttacgtattacttaactgagtagactgaatacaaaattcaaagttcctaagggggctgctttgtgaaatactgtgctgtgatatacacatcattagagatgagaaaactttagattcatcaacaatttagagaactatttctaaagataaatcctttgaagataatgtctttatgaacaggtttcttgggaaaaaaataaagttgtcaaatgccagtgtagcttttattatacatatatagagagacagcactgatgatttcaggaaataacacaaacacacatgcagtcagtgagaattctgtcttgtggaagatgatattgatgctgtgtgcagcccgctaataaaacactcagttgtgattagcagaagagctgaccagagtataaagtttcttacatgaatttttgtaaaaaactaaaaacaaaacaaaacaaaaaatgctttagagtgcttggcaacaaatgaagtcattcatataaaaaccatactaggggcttcaaaatgtaaagaaagagggataaatgttagagaggtggtacttcttggctgctaatggagaaagtctagtatgactttacaagtcaataacagcaaataaaaattactgggctaattttagtgaacatctgtgactggagtccactattttggcagaaaaaagggcaggtatttgccttctgagaactctggcacgtgagcggcacacattcacctacattcagccaatcaaaagcgttctcctagcattgctttagtctgaatgtatcataaagcaacaagaatagttcaaaatctattctgcatgtggtagcagcagcagtagcctgcatacagtaatagaggtgggaacaatggggccagtagcaatttaaaaactgtctgctcaggaggccaaggttggaggatcacttgaggctgggagtttgataccagccctcacagcatagggataccttgtctcttaaaaaataaaaataaaataagctagtcaggtgtgctggcatgagattgtagtcccaggaggatgactgggagaaccacttgagttgatgagttccagccaacaaagtcagaccttgtctctaaaaaataaataaatagtagtaatattcctttgggtatatacccagttatgggattgctgagttaaatggtaattctgattttaggtctttgaggaatcaccacactgcttttcacaaggattgaactaatttacactcccaccaacagtgtgtaagtgttccctttttctccacaaccatgccagcatctgtttttttttttttttttttttttttttttactttttaataatatccattctgattattgtgagatggtatctcattgtggttttgatttgtatttccgtactgatcagttatattgagctttttttcatatgcttgttagccttatgtgtgtcttcttttcagaagtatctgttcatgtcctttgcccactttttaatggggttatttttttttcttatgaatttaagtttcttatagatgatggatattagacctttgtcagaggcatagtttgcaaaaatgtcctcccattctgtaggttgtctgtttactctgttgatagtttattttactgtgccaagctctttagtcaatttttgcttttgttaaaattgctttcggcatcttcatcatgaaatctttgcttgttcctatgtccagaatggtgttacctaggtcatcattgagggtttttatagtttcaggttttacatttaaatctccaatccaccttgagttgatttttgtttatgatatatggaaggagtccagtttcaattttctgcacatggctagtgagttatctcagcatcatttagtgaacagggaattatttccctattgcttgtttttgtcagctttgttgaagagcagatagttctaagtgtgtggcctcatcttcgggtctctattctgttccattggtcaatgtgtctgtttttgtacaaatactatgctgcttcggttattgtgtcccttcaatatagtttgacgtcaggtagcgtgatgcctccgggtttgtcctttttgcataggattgccttggcaattcaggctcttttatggattcatattaattttaaaatactgtttctctagttctgtgaagaatgtcattggtagtttgataggaataatattgaatctttgggtggtatggccatttttatgatactgattcttcctatccatgagcgtggaatgcttttccatttgtttgtttcatctctgatttcttcaagctgtgttttgtatttctccttttagggatctttcacctcctagttagctgtatcctagctgttttattctttttgtggtaattttgaatgggattgtgtttgtgatttggatatgagcttggttgttgttagtctataggaatgctagtaatttttgtacactcattttgtatcctgaaactttgttgaagttgtttatcagctgaaggagcttttgtgctgagactatagggttttctagatataggaacatgtcatctgcaaagagtgatggtttgacttcctcttttcctatttggatgctctttatttcttcttttgcctgattactctggtcaggacttccaatactatcatgaataggagtgatgacaaagggcatccttgtcttgtgctggttttcaaagggaatgcttccagcttttccccatttggtatgatattgtctgtgagtttgtcataggtacctcttattattttgaaatatgttccatcaataactattttactgatcattctaccttaaacacatatcaatgttcattgcagcactatttacaatagcaaagacatggaatcagcctaattctcaccaacgacagattggataaagaatatgtggtacatatacacaatggaatactatgcagccataaaaataaatgagatcatgtcttttgtgggaacatggatggagctggaggcaaactaatgcaggaacagaaaaccaagtattgcatgttctcactcataagtgggacctaatgataagaactcatgcacacaaaaagggaaacaacacccactatggcctacttgagggtggagggtgcaaggagggataggatcggaaaaagtaactgttgggtactaagcttagtatctgagggacaaaataatctgtacaacaaacctccttgacatgagtttacctgtataacaaacctacacatgtactcctgaacctaaaagacaaaatttaattaattaatgaaaatgaaaatgaaaataaatagaacactaaaaacacagtcagtggaatcattttgcttgtggttctaaccaaccaacttcctttgatttctgaacattttcaagcctgaatcacctttattctcattgattccttttttgaaaatttttacatttttaatttttgcaggtacatagtaggtgtatatatttaggggatacataagatattttgatacagacacataatgtgtaataatcacagcagagtaaatggggcagccatcacctcaagcatttatgctttctttatgttctgtgaaccacacatcacttatatatttaggttattttctgctcaagatattcagagtcattttctattatttgccattcagtatcttgactgcaacccacaaacaatacccaatactgtggtggatacaaactgtcctagtttccagtatgagccaagtccctaaagaaccatatgattctttattattctgagcttcttaaagtttagagttatcacttaccataatttttgctttttacagtctgagagcacattctgatgtttaataaatacatcttgaatgaaagaataaagtaggtattttatacctaatttaatagaagttttattctcacagagttaaagaacaaaagctattttatggaacacgctaatcccactatcaggaacctataggaagaattatttgatcccatttgtaagaattgaacacatgaatgttaatggtacaaaagtggtacgcaaattcatgcttttttgaggactgtcctttctaatgattttgattccttttgctaatattataataagtaataataagcattcaacttatttgccaaagtagatataaatactttattagaatatgtcatccaacgaagattttgaaatatgtaagagtgaaatgagaagtccttggccaaaataaatcgactagtctttataaattctcaatctaccagagccttggctgattgagaaacacaactgccattgtaaaaatctccaaaaaagactgtgatttccattttctttccttgcaaactggtggactcaaataagcagaatagaatgaagcaaggtaacattttccgaaagtgaaaagcttctagagttatttgaagaataagtaagtctgtttacaagaaaaatgtaccatacataatgtgtttgctttaaaaagccctttgtaaaggtgacacaccaaagaccatttaaaatctaagtcattgtaagatagcttatgttgtcatgaatagaaaattgacttatactcaaggaacaagggcaggcacttctttgaaagaaaaaatttgaactaaggctcagtacttggaatagttttattttacatttttacaaaacatctgacagtgcttgaccagtaaaatttgtaatttagcagataatactaaggatttccaggtatgtcagaaatatttcaagtggatctgagtgaagaaataaaattgtatagaagttttattgtcagcaaatacaagataatgctttagaagaaggttatatgtatgagcccagaaaggttaccacttacctgcctgtagcagaggcaattactagcaccagaaagaatgggtaagagaaagacagaaatctgtgttatgggaggctagcaagtataaggcatgacatctcccattgaggaagcagggtacttggcaagttgtcaaaactgagcctcaaattactggaataaaagaaatttgattactagatggaacagggattagaagagtagtcaaatcagaggagaaataggccaagtcaaagcaggactccctgcagattctcttgaccctgatgttcatgagtttcttaatttcttctacattgagggtattttcctgtctttctgattaaagttcatattagtttctgaccttgggggtcagctggattctgcagttccacatcattcactccggcaaaggagagaacttgtaacaaagatgagtgccaagtttagtcaatttaccctacctggaatactatatacaactctgggtctcatgtgtgttaaaatacatacagtgaagctgaggaagagccactgaagtaaaaagtattgtttacaagttggaaaggatgtaaaaataatctaaagtatactaagtcaggaataaaaggcagagttaataaaattgtggctggtactgatagactaaacagatatattttctaaatcctggaataattattaaaaaattttacatgtatcaatggattccagactccatattttaagtatcacaactagtgtaatttaaaagtatagtttattgaaggtctggagtctgaataaagtaccccaagtgagtcttgtgagaaggtaagtttggaacacactgacttacaaattttgtgcttaatttatggattttgtggccctcaaaatatcatgtgggctaaacaaaagaatcttgaagaatttaaaataaatcatgtccaaaatgagttgtcaagagaaactgaatatattcttttggtaacagccttaacattttgaggagatatcatcaaaggttaactgttttttttttttttttttttttttcttaaactgatcccatgagatcagttttcttttagatgataccactttcatagcctgaggcaattaaaaatgtatgcttatttgttctctagtaggtagaaagttaagtccttaggaataggttgtgctttagtgttcttgaacatgtgagagtgtccttttctatactaatatttcccaaagaagactcagtattttatccacccactctgctcaaatacaccccatgcatcttaggaactaggaaaatagagtgattttcatgtaaaccattgaaaattcagaatgaatacctccaaacaaatgtcagaattacacatccataaaaccagtgttcactgaccttaggcttagcttagagttctgcaaagttttcaagatacaaataaattataattatcaatattaatagagttgtcaatgttcaccatcatgaagaagtaaataatagattgtgagaatgatatgtgaaattttcctatgatttatttaaagaatttaacaaagcaatgagattactggctagcgctcttgaagtcatgtttaatatagttgcctctttctagaacacatgctcttcaatgtttccttggatagataaactacgttttattctttgattttccttaaacaactacaatcaaaaacagatatccacttaattgttttaccttcaaggtaacatttatgcttatatccgtttatgccttcttaattctctgcaaactataacacattttaatgtgtgccaataaagttataaggtcagccatttggagctatctctggtgctttgaactcacagtatcgaagtaagattgggcatggcttgctatatttaatcttttcaatatatatagcttttgagttagacaaactcttatttccaaagataaatgtgcatttgagagtttaattatgtatttcttaacatttcatgtattttaggcatatatgaataatacatttcatgtattttaggcatatatgaataaataatatatgtacatttaaagttcaatttcatagaaactagtatacccctgaaaacaatagatgtgtctaggagacagaagaattgtcctttgtaaaatttcgctacagttgcagcaaagttatttgttgataaatgagagaaacagactactcataaactatggcctttgtaatactgaacagagtctagaattatgataatcatatggtttccgcgagatctagctgatatgcctttttgagatgataacttctgtccttgagacacttcactttttttttcacttatctccagcattgaataaagcccctcttttccctgttttgagtttgttatcatatgtgtcacatgattactatcatagtttactgcttcacaagaattcatacagttttcctatattttgggtgcttaccacatcccagaccaggtgttctagttccgtatttctatattttctcctttacagtgaaccatacttggctttcaagttccattttgctcttggaacctgcctgttctcagtccctgctttgcttttggttgctgccacctgtttctcagatgcagctccatgttcgacagcctgtggatatatcccaactacttccttatttagatcaggcttcagcctaggagaaggaaatttagatttgagcagaacatttaaataaagttcaaattgtctccaagggttataattataaagaaatcttactgtaggaggcattgggaagatacaattttagtaatcttccaatggattggttcatcttaattatttaattgtatttctatcaataatagcagtggcaagaaaagtaataaaattaggcctagatcgtttttcacaggtttaaatgcagtggtttatgttcccttgactgattgtacaacttcagtcacatatggtgaggtcaatatttattaaactatgcatccaagtgtttgtgagtaaaaatgtagtactttctagcattcatattactatgatagtatgcttggagatatttttgatatcagctttgataataaattttatctggaataaacctagcgaaactttttaaatccctaaagatgatagcatataaaacaacaaataatatttaaactgcactctcatttccactaatagggtggaccaagtttcttgactgcttcttccactaaaaaacaaacaaacaaacaaaaaacaaaaacaaaaacaaaaaactaaaagaagagataaaatgtaaaagcatccaaacatatagaagtgcaaacaagagaataatcatctaggccaaaatataaatgcgggcaggaattgagtgagaaaaaattgcttttatcctaaggacatatgccaaatctggaaacatcttagctttggtttctctcaagctcaaaaaaaaaaaagaaaaaaactgtactcctttaagatctataaaaatatgctgttttaatactgtttcattaaacatcataatagttagactattatgatgactaacctgatttcacagatgtttggctattgtgttttatcacccatcaggtgataagaaactttaatggtggtagactatatgcttctcaaaattgtgtgtgtgtgtgtgtgtgtgtgtggtgtacacattttcttaaactgtagaaagagcatgcgttttggtttcagacctgtgttggaattctgactttccttcatttgatgtgatgcagattatttaattcctccgaagacttggtttattcatctgcaaaatggggagaaagatacctatgtcccaggttccctcactcctcacatccaatccattattgaggcctgtcatttcttctttgaaaaaatatataataggcataatatttctgagatgtaagccaaccaatgtattttctttcttggaaatttctggtccctagttgtctcatcagtctatatcaagagccacccctggtagaccttcattggagagttagttttatattatggagaggatactgtttccacctgagtttactaggtcatgaggctcctggcctataagaataatggccaaatgatgtaagataaattcagattcgatggaaagagaaacgggaaagcttactctttctggtcctttagaatgtaggaaaaaaagaagcaagtagttaaccacatgtctgttcctgtttgaaatcgtagaagtggagaacgaaaaggagcagatgcttgtgtctcttcttattgaaaggctacttaaaataggccagcatcagtggtgggggtccagtaagagttaaaaagtgtttcagaaaatgtttaagcaccgaaaggatttaaattagtcatcacaggtgtccttaacagatgcagaagtttctacctgccttgtggtgggcagcatgatctatgcattgagaagtaggttacctgcagcaagggctccgtaactgagaatgagtgtcttcccccacagaatctgaggtctggcagctcagacagaagctgggtggagggtgtgattgtgttcagaaggtccaccagtgcaccaagagtcaagatgagaccaagtcagcaaaaagaggaccccaaacatttatcatacaagagaacaaaatttcatcaagtacaatcccagtaagagaagccagggaaactctcagtgaccaggtagtaaagggaaattctccaaagggaagagatgaccccaacgacagccacgaccctgtttccaacctcactaaggacatttaagcctgcttgttctccacagaagtcacatgctcctatattaaattctacgattttaaagttttaatatttatatttagatctttaagactctgtgaattgtgtatgtgtgtatatctgtatgaaatgtagtcaggatctgattttaccatttcccatgtggataacttgttccagcattccttcttatctcagagaaaaaggggtccttcttaacactaactcttccacctgttctttcagtttctccatctttccacctttcaaaatcctactccattacttaacctatttcatttctcatcttaatttctttttttctaccattttcatattttctgtttacaaatgggcttatgttccctctatttccttcaacccacatttatacatcagttaaggccactatttttaatttctatcaagttctttgaaatgataacaaatgtttggtgtgcatgctcttaaccttctcccaatcatactcagactgcagtatttacctataacctagttactaagtcagttaacctgtttttgtccctcatcaaatgtattatttttgctgcatctaatatggcctgtttacttcttgatagtgttctcacttttagttctgtgacattatttttctttggttttctttccatctacctggtcactgtttctgtggcatttttccttgttgttcctttctctcagtataatgaatctgtccatagggaaaaatagaaataatctttgaaacattaaagttctgttgataatataaattttattgatgattggaaatatagcctatctctaatatagttatttgatccctccaagttataaataaattatataatcaaattaatatcataaaaatttatttggttttctattgcagatgttttctttctccttttatttcctctatgattgagaaaatcatacttaacattgtcaaaaaatgaacacatgctagttaaaatacatttgggatggaagttaaatatgtgttatttatcagcatcaagccagcattagaattaaaaaaaaaaaaaaaactgcagtgaggttctttttattaaaatgtaaccaaaataactcctttgaaatagttatctttaagattgtcactggttattttttatggtttaacactctcaaataaatgttcatcttgcaaaaatctgcatgtaatacatactgatgcataaagaaaatgcatcaactaagcagattgttctgtgatgacttggattatcaaacatttgcaagttaaattcaatattactgtataaatttgaagaattaactaaaattaacataatttatttattctgttagtgaataaccaaaattttaaagttcctcaagctattttaaatgcttattaggataattataattattcatttctatttaaaaattaaatgatgttagccctacagtgtttggtgaatataaaaatatatatcattgaattataaatcattttgtctccagctgccaacttgaaatgccaggcatttcacttatcttcatatttcatataatgttgaactatttatggtccctgtgctgccatatgtaaaagagcaatattcattaactcttcatgcttcatgaagcaaaaagggttatttcatttgtgagcttctttcgtaataaagactcgtcaaattttctacgttatttatctttgccaccttacgtgattgtaggcatccagaattttcccactgagagtgtttattaatttgttttcttcatagtaataaaccataagcccagtgagggtaggcaacaggttaatcttatagtcattatattctcagtgtttaacaaattgcctgattgagatgaataagtgcatttattttcaagcattttgtttttatttttgatatagttattcactaaaacgatccactcacatcacttattcatgcctgatgttgtcaaaacaatattaaaatatatcgcttcatgtcagagaccttcagtattatatctgaagacacaggttaatacatgtggatcactttcagtgtaaaacattgtcctattaatactacttgaatatcaaagagtacaaatcaaataggtattcagaaaagagggtcttttatggggaatcagactcctggaagtgacagttgagtaaagcttacaaaaagaaatatttgcaacaaataagaggaaactttcctttccacataaatggagcaagacattgagggcttgagaaaggaaagatcataaactattggagggtataggaggctccagagcttattaaaaaagaaaagagtatgtttggaaattttgtgttattttatctagatataaaggattctgaaaggcagtgaaagtactttttactccagagagttaaaaaaaatatgggtctaatgaatgactgtgaagaaaagattgcacccagtgatgtgttgagggaggttgaaggtagattgaaaagtagataaactgaagtggagtgtagaattgagtcagtgaagatctgggttaaggttgggacaacagctgtgaaaggaagaaaaaagaggatggggtgattgatttgagacagttacattaaaaaaaaaaaaaaagtggccaaactgaaacaaaggtgtcaagtctggataaataaatgagcaaaggtgttataccaagattgaagaattgagagatgtgggtaagtttctgatgtatgaaatttgagatgatagccagccagatacttatatgaaaatatctaaaaggataaagaaacaacttaaactatgttatgcaaaataatttccatgtcccacttaccatatcaaatgcatatacatgttcacacagttttcgcctctttaattgcctactttttccaggaaattttctttacttattctcatttttacaaaatattttataatgcctttgtatcaagaagagtaagatattacacaatcactttaaacataaaattacctatttgaaaaagatataaagtttcctttcctttaaaatggggataacacttgccctacccagctcacagggttgttgaaaggatcagaagaaatgatgggtatgaaagcactttgaaaacgaaaatcctttacaaatgcaagctatcatcattatgattatactgtctcctccatatgaacctgaagcaatttcaatttccatttatcacgttactcccctaattcctgtagagcatgtcccacaagatttttatcatgtgactctattttaatcaacgacaaatgcattttcatgaaagcataatattatttctattatagatattctttgaactctggataaagaataatacacatttcaaggaccattatacttctgagagttttttcctatctctttcatttcatagcttcctttctcccatattacatgggtgcaatgaaattttcattgagtgaagtaccttataaaaacttgactgtatgtcccatcctcctttcccctgattttatctttttcttactctgtgaattcaaattctctgataagcaccatccttcgctctgtggattgacaccagtccgtcctaggtaccaaattaaacactgaagatgttttaaggagatgatagcaatatcatgctcattatgtagtggagcttaaaattagagcttggtaccaaccacatccaaaagttgacatgttaaagagagttctagttatttttaaggctacctatgcctctactccattccttctccaattaatactaccccaattcttgcaacatttgttttgtgccctgggcataataatggcaataagataaagagaacctattggtacacataggttgtacgaggacctaaatattcttccacccccacaaagtccaggaaagtaaagcaaaagttaatcctttagtcagcttttctagatgtgcagtatattttcaagcattttgcgtgtatatgagtaatcagatgatccatttacatatcttaaaattgttattttggaaaaaatagcaaatctgttacaaactaaactacttttacattccaaacttgttaaagaaaaaaaatgctgattataatattaaatggaggaagttaaattcaatcaatttctaagagctatataaattagttttagagcaacccaaatttcagttatataacattatttttcaaaagaagttcttaaaaaccatctaattatataagacaaaagattagaatagaaatgaaccttaaatatgatacttacttcatctaatgtgtgagggatagttttagaacaaaagggacaaggatgagtacaccttatccatctactctcagtggttagttctgaagggcttcttcctagcttcctgtcttgggtgtaaaagccacattgctgtagaccattgaacaatgtctgtcttcattctgttactcctttcctggaatcttccacatgccttctcctcaagattgactctctttgtctcagaacttgattgaacagttcataggtttacgaattacctttgccactgtatggctttcctagctgcacctgacagggctagctagcctttgatgttatgcacaattcaggcatctcacagaccacacttagtaaactgatctgtggctggcccttaacttggccattcaccttcatcatctaagatagttgccaaggttcaccatgcttcatctccaggatggcatggtaaggaactgattttaggaccaagtagccactccctcctttctgtatcattctactgcctgtcaaggtggctttattatatttcaccctgacaactttcactctgtctctctcctctcttggcatttatgcaaagcagtgtaagcattcacttgggaaagagaggcatcttggcaaagctgggtcttttctgatacttgaattagatcaccaggtcactgcagagttatagaggaaatagactacatttaagaattttctataattgccagaagtccaaacctgtaattactattgccactctgggagcttcaagtgaagcctctgtagttagcctttgcccttatccatcctgactttcctaccatattttgctactttctcctttgttagaatttatattagaaatagatattttaaaattcagctcaaagtttttagactagtacaaagaatattgtttaatttacttgttacataacatgtatcaacaagcagaggggaaatttaattggtggtaatataattgttaattttaacaaaaattgggaacgtttgactttgaaattttcagtttttgagctcataatagaagacccatgaccactttgtaacttatcatttcaatatagttccattgggtagtagtacctttattctgttttgaagataaggacactgaagggcattacagatgaggatactggaggttcaagagttcacagattttcctggttcagcaactgagagctttcagacccaagtgctatatattggttaccacactggcctgcctcttcctcacttaaattcatccattgactacatatcatcttcaggataaactaccaaggaatgttgcaaggcctttcataatatcactctttcctacctcctctgtcctgttcttgctagttcacttcctatacttcagcattctaaacctcacggagagcccttcctctgaaaatgttgcctgtccttttcacctcaataactgacacctatttgttgggcccaatcctctggggaagccagtgtcatcagagttggcttcagatggtgtcttgtgaaatctcttttagccgttagtgctgttaaattattggttcccttagataaggcttgtgagggtagagagtgtctccttcacttttgtttcctcttttccattgtctataaaataaatataataatagctaccttgtagatttattggaaggattagaggtaatgtatgtaagtaacgtaactagcagtgccagggacatggtaataaaaccaacaataactcatatttattaaaatcattttctgtgtgccaggtactatatggtaggcacttaacatgtattatctgtaatccgtatgtaatgattactgaatggcctgaactcaccgccaaaaagcacttttactttttttcttcaagcatgttatcaaatcttctcatcttgtggtttgattcaacttaggcagagaccatagcttttctgattttgtcataaacacaatgtaatttcaataattaaaacttatttttatttattaaaatttccaggctgtacttaattcaggtaaacttcaaaatcactcctctccccttaattcagtcctgactcctgcctccagctctgcattgcagagtttgttgactgtattttttaagtatctctcagtaatcagtgcctctgtcaatggcagggattgactgccatgtagaatatatgtgtaaactattcagagaaccactctctcccctacaccacactatttgggatcccatctttctgacaaaggacatattcgctttagctaccactcagctccagctctcagcagcaattccagaatctccttctgcagttcccttacttatttgggaaggtggttcttttctttctttctttctttttttttttttttgattgtaagatagctacattttatttttaaaatttattattatacttcaagttttagggtacatgtgcacaatgtgcaggttagttacatatgtatacatgtgccatgctggtgcactgcacccactaactcgtcatctagcattaggtatatctcccaatgctatccctccccctacaccacgccacaccagtccccagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatccttttttatggctgcatagtattccatgctgtatatgtgccacattttcttaatccagtctatcattgttggacatttgggttggttccaagtctttgctattgtgattagtgccgcaataaacatatgtgtgcatgtgtctttatagcagcatgatttatagtcctttgggtatatacgcagtaatgggatggctgggtcaaatggtatttgtagttctagatccctgaggaatcgccacactgacttccacaatggttgaacagtttatagtcccaccaacagtgtaaaagtgtttctatttctccacatcctctccagcacctgttgtttcctgactttttaatgactgccatttaattggtgtgagatgatatctcattgtagttttgatttgcatttctctgatggccagtgatggtgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgtgaagattttctcccattttgtgggttgcctgttcactctgatggtagtttcttttgctgtgcagaagctctttagtttaattagatcccatttgtcaattttggcttttgttgccattgcttttggtgttttagacatgaagtccttgctcatgcctatgtcctgaatggtgttgcctaggttttcttctagggtttttatggttttaggtctaacatgtaagtctttaatccatcttgaattgatttttgtataagatgtaatgaagggatccagtttcagctttctatatgtggctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtatcagtaccatgctgttttggttactgtagccttgtagtatagtttgaagtcaggtagcatgatgcttccagctgtgttcttttggcttaggattgacttggcaatgcgggctcttttttggttccacatgaactttaaagtagttttttccaattctgtgaagaaagtcattggtagcttgatggatatggcattaaatctataaattaccttgggcagtatggccactttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcacgatttggctctctgtttgtgtgttactggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctcatttattgacagttttttgcatgaagggctgttgaattttgtcaaaggccttttctgcatcaattgagataatcatggtttttgtctttggttctgtttatatgctggattacatttattgatttgcatatattgaaccagccttgcatccctgggatgaagcccacttgatcatggtggataagctttttgatgtgctgctggattcagtttgccagtattttattgaggatttttgcatcaatgttcatcaaggatattggtccaaaattctcttttttggttgtgtctctgcctgactttggtatcaggatgatgctggcctcataaaatgagttagggaggattccctctttttctattgattggaatagtttcagaaggaatggtaccaattcctccttgtacctctggtggaattcggctgtgaatccatctggtcctggactcttttttgttggtaaggtattgattattgccacaatttcagagcctgttattggtctattcagagattcaacttcttcctggtttagtcttgggagactgtatgtgtcgaggaatttatccatttcttctagattttctagtttatttgtgtagaggtgtttgtagtaatctctgatggtagtttctatttctgtgggatcagtggtgatatcccctttatcattttttactggaaggtggttcttttcactgggatctcataaagctagcaaattactttctgtgggatgactgagcccatggaaacgcaggcattcttgtcatgtctaataatgggatgtagttcctcccagtccactgtctcctctccttgttttctgctgttatagactgcatcagccaacattatgcattctgaattctccaggagggactgaagcagtcatctcaatgttcacacgttcctccaaactttaggggccacatgtcagtttgtttcagaatcttctcatcccagggttatgtggagatttggctgcacatctctgcagctcagcaagcctgaggtgagaattgagacactgctttctttgccttgcaaaatgcaccactcacttaacatatgggagcacttgtgaaaagaagacaagtcagaagcccttctcttcccttggataacatctcattgcgtggacgactctttctctctcaaaatactccataattctgcatttgagaggccagaggtggtaggttggtagccggtttggctgcttattaggaagccctaggaaaggtgcctagtgagtgctctttagaatcccttctgttaactattctcaatatttagggtttagctgaaatgtttgaaacaaagaaaagtcctatttcacatcttgtacttttaaagcactcatttacatctaaagaaatgtgactgtagaagttaggttatattccctaaggccacaaaatttacttattaaaagtcaaaatctgatttgtctgtaggttattctcaccccaaacctccttttcagttcattgtactatttacctccaaatatgattgttcaattataagtggttactgtagggcatgtgtaagttgagataaacagcaacagaactcttcagtatttatttagatacagcataaaattgggttttgatattgtaggcatattaaggctagccagcttaattggctcctgcatttgtgctaacaactattagtctttaccccccagtaagtgaagaaaatacttgatatagctaaagtagtacctagctcattctgagacttcagtaaatattggttaaatgagagactgcaggaattcaaagtgagctgatgctgccactcccaacaaacagtgacttctgctgagttttttctgatacttttactgtgaaggtctcacttttgttcatgcatctgtcatcaacccttatattcaaggaaatgtctccagaatttttattggatgactgcattttccttacatgcaagtaaaagaaataccaggctttgaaagcgggctgattgagtgagagttgaacatttaatcagcaagaacgcacttaaaagtgccaagttgtagcaaaatctagggaattttaactttacatatgaaatccttttctgctccactatagcctcaactttctttcagtttttaaatttagaacattctggtaaatggccactgcagaagagtttaatatggtacaataataattcttatttttctcttactgctcaaaggaaaaaaaatctggataaatcccagggacctttaaggagttttagaaactgtcctcttcattaggttaatccactaaagatcaattagttaaaatgctatttgaaatatttagttcttttcttagagataaagtattcatttgtaaattgaatctattgaagatatttccatataaaataaagagtgaaaaacaaaaaaaaaaattgaatcacagctgctttatgtggactgatagataccttagtgcatttgcagcacaaatccaacatttaaaatatttaaaaatacatctctgtatgtggaattttagaaagtattaagctatagtgagagaaagctgatcagcctgaaggagttggggaggggcttgactgtaaagagacatcaggaaacattttcaggagttagaaatgctgtctatctcgactgtgatagtggttacaggaatatttcctagttgcccaaatttacccaatggtatacttacacaatgggtgaatcttttgtatgtacattaaagctggcgggtggggagaagaggaaaaaaaatcttattgaatttgggctattttacttgtaatatcttttatcctgataaaacagatagtactgtggtagacaaagtgttttatcatctacatagaataataaaatctcaaatttcaaatgttattcattcactgttagtcaattggcattaaagtgttgctttctgtgtttcaggaacagtgcaatttgtgaggtacagaaagccaaataaaacagtctttgcctaaaggaagtgtaattcattatccattgctatgtaacaaattaccgcaaagtttaatggcttaaaacaccacacatttctcatctcagttatcatctgtgagtcaggtgtccaggtgttgcttagttggtatctctgtctctactttggggtatctcacaagactgcaatcaagaagtcactcaggcctgggatctcatctgaaagctagactggtaaaggatccgctcccacgctcacttacatagtcgttggcagaattcagtacttcaagtgctgttggactgagggcctcagtttcttactggctgttgaccagaagctgccctcagttccttgacaggtgaccctctccatgtgactccttcatcaaagagtgcaggctgaaaaggcaatagatggtcagttaggaaagggaagtcacaattttttataacccagtcacagaagtacatcccttcaatgacgctatgtactgttgcttagaaggaagctacccaagaaaagggaattaacaaggacatcaatatcaggaggaggagaccactggcggtcattctaaaggctacttaccactagaagcctagttgattcaacttactatccaggattaatacatcaagaagtcatccagcaagtgctttaatcttttctgctacacagaatagtgtataagagtggtggctttataatcagacttctcttgcttaagttgtcgctaacccttattagccatatatctgggaatttattaaaccttctaagcatcagtttctcaccataaaatggtgtatacctcataaagtgtgaaaattaaacacaataatgaatatatagttctgagtatggcacctggcaaatagtaagcatgcaaataatgataattattttttattatatatctacttactttattcctcacttgaaatccagctctctgaattttcctgttgttgaaattagtttaccaacttggaacttattaatcaccatatccactttaaaatcctcaccctgcctttaatttacatctgaagacagtgtatttgttgccttcattttctccctacttgtgcacactccagtcttccactgtttctacagatgttccttatgtaacatgatttcaagtgtcgttcacttccttctgaccacatttgttgcattataacataatgaatctgtaagtcatcacatacaactaaataaattccaggtgtagcttgttccatgcaaaaggaatcaagattattactagtgatgtaaataacctatatgtattgaacaattttaagtagtttttaactagtacaatgatattcatgaatctttttcttgaaaatgatagtagtttacaaatgatctaaggagcagcaaatattattaaacactttgcgtacttccatccagatttatcaaaattgttatgaagctgaaagcatagtgcaagaatacagtttggtgcctcatggttctttttatgtactttgtttaatataaggtgatttagcaataatatgattaggatgcttactgtaaaaactccttatctctattattgcttaggcacatagtttttttatagttgtaagacatgaaatatttatctatatgctataatgaactatttactggatataccatatatatgatgcttattcactggtgataaacccatgattgtttttaaatatagattttcatgattagattaataatggaattcacactctttgatagttcaccattatatgcaaaggttttttacaaaaatgatagaagttccaaatattttttcccaagttcacaattcttacaagctcacataaaaataggaagtgtggtttttctcaggggtggcattttctcattattctccttagaaaacataataaagtgaagttcatttactcatttatttttggctttaatattaaacacaaaatatatttttattggaaaggtcaacattgtttatttctgcttgttaaagtatacatgttcctggtaaaacatttaggaacaacaaaaacacaaagaagaaaataaatattaccataactcatagacaattgctgacccatttaatgcatattttagacaattatcataagatcactttttttctgttggaatattagtattttattaaatgattttttaaaagtccttgtatacatatatacatacatgtagtgaagatttaggcttaaagcattttttatttctgtctttgttgtcactgttaggatgctttatttctgttgcaaccacattgtgtcctcttattattccatttctaataaaaaatatagaataacaatattaaaacataaatttttccttgtatgttgtttgtgaatttttgagtgaagttgttttcaataactcagaattttgagttgaaaatacgtgaggatttctgtgatcaaatatttgttatctttttgtaaagagtgctgatttgattagttctaaaaatcatcagtgtaatctgtaaatgatgtaatccgccatcagcacttgcacttttcttcagattattatagaaattcaaatcaataacattttgttgttttctattaaataacatttggcacattacgtatgttcatatggttaccaatattccttaaaaatagcaaggttttaacatgttcatgatatccttaggtagagtctaataacagagaacatttgtgtgaggataactattttaaaatatactctcttttttgaaatagattgtgaaataatctttggtaaaatctctatctttgttaaaaattcccagaatgagaaatgtgaatgtaaaatacttagaaaacttcctttcctagggatgtaaatttcactattataatctttatttataagtcactcgttaaaatggtcttgcttctaggataagaatgcagttcttcatagaataatatctaatttgaagttttgctaatagttttggaagtgaatgtatttttttaaagttttaaatacattcattttagcatattgctttgactatatggactaatttatcaattaaaatatttctattttcatttgatagtaatttttttcaaaaacttatattgtttataaactcagcaagtcttcagaaacatgtttgagtttgttgtatgcatccagattaggtcctagatcaggatgcttttgaattaacttgaaataagaataatatctatggtctatttttatttgaaagttttaccttcccatgatgggctcattttgttaaggatttctttaaaaatttgtggcatatatttgaaatgaagctgcctaaaagataatttatatagttcttaaaagatcatcaaatctcaggtctgcatttaatatttcaaccagtaatgttattgtgctttaaaaactctggtaagataaaagtagacttttacaaaatgaaattgtttcatttattcactcattcattcattcaataaacattaaagaacccttgttcatgttccagacactgggtatataatcacctgtggactagaaggaaaaatgacagacacagaaaccattttaaagaagataatacattattgttaattatagttaattaaagaaaattaatgaaaattcctttgatataaatacttaggtcttacctatattagtaatgtccacctatttttaattaatagagattagcaactctgaaatttataaattgttaaagtttttcagtaagcttttaaggttgtgtgagatatagttttagaaaatatttgaaaaaaaaagtcacattaaaatgatcaggattgtcttttgtttctgttttataatcaagggcctaacatctaatatgtaaatattcttctagtaagcaattaatgtggttattataatcttattattcatagaatatcccccccgccccataaatatcaacttcctaatccccagaacttgtctaagttacatggcaatagggacttagctaatgtggtcaacgatcttgagaagggaagacaatcttggattacccagttgggcccaatgtaattatacagtcctagtaagaggcaagccagaggatcaaagacagaaggaaatggacaacagtggcagaggccggggtgatgtgccttgaaaatagagggagggctccagccaagggcaccttctgggatctggaaaaggccaggaaacaaaaatttctcccagaaggagtgtaccactacctataccttaattttagtcctgtaagactcctttcagacttctgacctccagaactgtagaaaataattttgtggtattttaagtaatttaaatgtatgataattagttacagaaacaataggaaattaatacaaacctacacaattataacattgtaaaatggcctctgttgtgacaatttaacaaaatgccaggttttttccccagaaaaatccctgcagagatgattagctattagagcagagtgtgaaaccttttaacaaaggtaggctagctggtaactgcccattattaccaactaagtctttgaaggtagcaaagcaatacaaaagcaggtactcgtgtaacctaggccagaaccaccacatttattgatttttcatagcttccttttaactgaatccccagataccactagaattttatgaaatgacttaagaataagacatttgaacatgaaaatttaggtgtttcttcaactgtcacacattcaaagagcccctcctggtaatctgtgtgatcatgttcttgcatcagtcgcagacaagcaaaaagctgaactcagtactgcacctcctgttttctgggagtatttaattttaagagagacccatacttccttttataaggtgaagggaaaagctgtaatagcttctttgccattagttttgaaactctagagttcattaaaactccctttggctttcttcactgccatctttctttcttcttatgaattattcaagacaaatttcacttgaggtaaatagtttgatttgaaggtttttgtatctggatttagatgcaacaagaagtgttaaatgctcagaattttaagtgtagagaatggcacagactcagctattaagatggaagacatttgctgttaatgttccagggctgctgttgcgacttcagcttggtactattattcattctgaagtaggcaggcattatgatgcctgcagtataaatcagattttacagagagcttgatccgcaagcactttgaacattccatccacttctcagttaacagaacattttttggttttacaaggtaaagtttcttttttttttatccttgccaatacattattaatctctttttttcatatattgtataccaaaccacaaaacagttttagactatacatgtctcttgaataaagcgaaattgtaagttttgaaagtttcttctttcaataaatattgtgaaagataagaggacctagaaaatatttcatttttataaaactcaacgtaagaccctttcttctttcacagtagtaatatcttttctagatattgtgtcataattttaatcttttaaacacttagctcatggagtcacacacctggaaaaatgatacatggaacatatgtctgaaaactaccttattttggaacttaagaattggttcaatgaatgtaccacatttaaaaaccaatccaggccagtgcagtggctcccacctgtaatcccatcactttggaaggccaaagcgggtcgatcacctgaggtcaggagtttgagaccagcttgaccaatatggtgaaaccccatctctactaaaaatacaaaaattagccaggtgtgttggcatgcgcccgtagtcccagctactcgggaggctgagacaggagaattgcttgaatccaggaggcagaggtggcagtgagccaagatctcaccactgcacttcagcctgggcaatagagtgagactctgtctcaaaaaaaaaaaaaaaaaaagaactatgcaaagaaatcttattatagttttgtctgctactaaaattcactttcctaatgtcagtttctattaaagttgcctagataaaattatgtttatgaaattatgcccaggtagtactgctttcaggcaaagcatttcattcccgtttcctgctctaacacaatatcacaagcagcaggagtttcattactaaagaataataaaaaacatttattaattgctatatgatagaacatgtgctaagtactttacatgcatcacctaagttaatgctcacaatgagtcttagaaatagtttctgttagtgcccccattttatagctagacagttacatggagagcacagtcttgtaatccctctgtaggacatcagaatccatgtccttaaagactaccaataagtgcaaactcaaaatgtacaggaacatagatttatgaagttgcctagtataatgcaatatgaaatggtggatactgtaacaaattgtcaacaatttacatgcatttatatttaaactacaaatccagcaaccaataatttatttgtgggctatattcaggtttcagccctctggtttttaactcaccacaaagccacactgctttcaaaaccgttcatttacatgcataattattcctttatttatttcaatcttattcagattttatcaggcaatggaaacatgcagagaacagaattacattgtaattacattgtaatcacaatgtcttataaccctttccatggtaaaggattacccattagcccagtcatgtagtttacctgttgttagaagggaagaaggaattctcttctaagtctgaaggagacacaggttgagaatcttttatccaaaatgcttgggggccgggtgtggtggctcatgccgtgggtggatcacttgaggccaggagttccagaccagcctggccaacatggcgaaaccctgtctctactaaaaatagaaaaatttgccaggcatggcggcacatgcctgtaaccacagctacttaggaggctgaggcaggagagtcactcgaacccagaggcagaggttgcagtgagtcaagatcgtgccactgcacttcagcatgggtgacagagtgagactctgtctcaaaaagaaaaaaaaaatgcttgggaccagaagtgtgtcattttttggattttggaatatttgtatatacacaatgaaatatgttagggatggaacccaattctaaacataaaatttatttatgtttcgtatacacgttatacacagagtctgagggtaatcttatacagtgttattaataattatgtgtgacctgtcacttgaggtcaggtgtggaattttccaagtgtggtgtaatgtcaacactcaaaaattttcggattttggagcatttggagtgcagattttcagacttgggatgctcagcctgtgctggaattgcaagaatgttcagactcaaaagtcaaagaaaaagttgagttctgaagagggcacattaattgaaggggccaacaaaatgtattaaaatttagcctgtagtgctcagtgtcttattgccatgaatatgagagtgatggtggctaaggaagggaactggagccatatttctaaatcgggctttatattttgtaggtgattgtgccagccatagtgtaaggcagacatgagtcatttttcaagggacttgggatgaagtgcatgtaaattttggacatgaaaatttaagggcgaaagagatgtttaaatcctctaaggaaagctatgggaaagctgtgtaggcaccattagtttatttggatcatgaagtccaggtaagagattttcatgttcatgtgtcaagtaacaaagataagtaggaaaagtgttgtcatgtgttttattatttaataaggaaatacattttgttatgaatgaatacatttttttcttggcgtgtttaattggtattccttctcaaaatgtccaatgactcatcaacttagttatggcaggcatcttaatttgttaagttgcttaagttttctggttgttcatttccatgaagctgtgtgtgggatttataagctttttcccccaatggatatgctaataaaatacaaagtttgaaaatcactgagactgattaatcatattcctgtcagctctaaaattcagcagctcaacagtcagttatgtcaagggtgtccattatctgatcattctttctactgaaatgtgctttcttttcttcttcttttttttaatcttttcttctattctgttactttctattaaaaaatgaacttcattgaatcttaactcaatgtttcagtgtggggaaggtttactcaccattatggaacatttgaaaatatgtaagaggccaggcgcgatggctcacacctgtaatcccagcactttgggaggccgaggcgggcggatcacgaggtcaggagatcgagaccatcttggcttaacacggtgaaaccccgtctctactaaaaatacaaaaaattagccgggcgcggtggcgggcgcctgtaatcccagctactcgggaggctgaggcaggagaatggcatgaacccgggaggcggagcttgcagtgagcccagatagcgccactgcagtccagcctgggcgaaagagctagactctgtctcaaaaaaaaaaaaaaaaaaaaaaaaaaaaaaagaccttactattagcatttagtaaccagttagggatattgttaaacatcatgcagtacatcagagaatattcttatgtaaaagatcaatagcactgtttttgagacatattgaaatgggttatgactctatagcctgacagacattgcagtaaaactttttttttttttctgataaggactttaatttctggatttatttggtcatgctctctgcctcaagcacctttctagttaccctgtcaaaaatcttgtttgctcttgaaggcttagttcagatctcatctcctttgtgaaatcacttgtaaccctttcactttactataaactcagaggtctccctactttttgatggcccttgtataatctcttgaacacaagcttgaataatctccaaatgcaatggcaaattgagaaaaatggtactggcttttccattctgctttccgtgtgagttgtgtaaaagggccaagacatatcacttttgttttgttttatttaaattattgttcctacagagaaatagatgataaatactgaaataatagtgagtcatccttatacacaaaaacatcaccatagcaaatatgctacctaagataaacatgctgcatagctcaacctaactttacttatttgtagttaattcactataagaactcattgagagtacagcatgaaacttgttttttaatatcctttcttgctgattgtgtctcaaatccataacttagattttaatatatagactacctgatgataataatggtgttctagaaataaaggcagctttcggagcttctcttaaaaaaattaaagaccgtctacatgatcaactacctaccagttaactgaaacaagactgggtatcactggcccactgtcctagttcaaactcaatgaaggaatcaacactattctagatcatattcttaacactatgatcttagtgttaagaaatagaaaatccttgactcctgccatatgtcagtagtgaaaatagacccttccaagaccatttccaatccttacctctagaaattacatgctgtttctgattttcagcacatctcaaagagattcatatttcccttgagttacagttgttgtagtttgtaaaaatgttcctatttctccatatcctctccagcacctgttgtttcctgactttttaatgatcgccattctaactggtgtgagatggtatctcattgtagttttgatttgcatttctctgatggccagtgatgatgaacattttttcatgtgtcttttggctgcataaatgtcttcatttgagaagtgtctgttgatatcttttgcccactttttgatggggttgtttgttttcttcttataaatttgtttaagttcctggtagattctggatattagccctttatcagatggatagattgcaaaaattttctcccattctgtgggttgcctattcattctgatagtttctttttgctgtgcagaagctctttagtttaactagatcccatttgtcaatttttgcttttgttgcaattgcttttgatgttttagttatgaagtctttgcccattcctacgtcctgaatggtattgcctaggttttcttctagggtttttatggttttacgtattacatttaatctttaatccatctcaagttaatttttggataaggtgtaaggaaagggtccagtttcagttttctacatatggctagccagtttttccaacataatttgttaaatagggaatacttaccccattgcttgttttcgtcagttttgccaaagattagatggttgtagatgagtggtgttatttctgagggctctgttctgttccattggtctatatctctgttttttttttttttttttttttttttttttaaccagtaccatgctgttttggttactgtagccttgtagtatagtttgaagtcaggtagcgtgatgcctccagctttgttctttttgcttaggatcatcttggctatatgggctcttttttggttccatatgaaatttaaagtagtttttttctaattctgtgaagaaagtcagtgatagcttgatgggaatatcattgaatctatgaattacttttggcagtatggcattttcacaatattgattcttcctatccatgagcatggaatgttttttcatttgtgtcatctcttatttccttgagcagtggtttgtagttctccttgaagaggtcctttatatccactgtaagttgtattcctaggtattttattctctttgtagcaattgtgaatgggagttcactcattatttggctctctgtctattattggtgtataggaatgcttgtgatttttgcacattgattttgtatcctgagactttgctgaagttgcttatcagcttaaggagttttgggtctgagacaatagggtttctaaatatacaaacatgtcatctccaaacagataatttgacttcctctcttcctatttgaatacgtttatttctttctcttgcctgattgccctggccagaacttacaatattatgttaaataggagtcgtgagagagggcatccttgtcttctgctggttttcaaagggaatgcttccagcttttgcccattgagtatgatattggctgtgggtttgtcataaatagctcttattattttgagatatgttccatcaatacctagtttattgagtgtttttagcatgaaggagtgttgaattttgttgaaggccttttctgcatctattgagataatcatgtggtttttgtcattggttctgtttatgtgatggattacatttattgatttgcgatgttgaaccagccttgcatcccagggatgaagcctacttgattgtggtggataagctttttgatgtgctgctggatttggtttgccagtattttattgaggaatttttccatcgatgttcatcagggatgttggcctgaaattttctttttttgttgtgtccctgccaggctttggtatcaggatgatgctagcctcataaaaagagttagggaggagtctctctttttcttttgcttggaaatttttaaaagtaatggtaccagctcctcttggtacctctggtagaattcagctgtgaatctgtctggtccagaagttttttttggctggtcagctattaattactgcttcaatttcagaacttgttattggacctaatagacatttatagaactctccaccccaaatcaacagaccatacattcttctcagcacaacataacacttattctataattgaccacataattggaaataaaacattcttcatcaaatgcaaaagagtgaagatcataacaaacagactgtcagaccacagggtaagcaaattagaactcaggattaagaaactcactgaaaaccacacaactacatggaaactgaacaacctgctcctgaatgactactgggtaaataatgaaattaaggcagaaataaagatgtttcttgaaaccaatgataataaagacacaacataccagtatctctggaacacagctaaagcagtgtttagagggaaatttatagcactaaatgcccacagtagaaagcaggagagatctaaaatccacaccataacaattgaaagaactagagaagcaagagtaaacaaattcaaaagctagcagaagacaagaaataattaagatcagagcattactgaaagatccagagacatgaaaaacccttcaaaaatcaatgaatccaggaggtgtttttttgaaaagattaacaaaatagatagaccactagccagactaataaagaagaaaagagagaagaatcatatagacacaataaaaaatgataaaggggatatcaccactgatcccacagaaatacaaactactatcagagaatactgtaaacacctctatgcaaataaagtagaaaatctagaagaaattgataaattcctggacacatataccctctcaagagttacagttttaaagatgactttgattttcaagttttaacaagagaatagaattgtttcttcaaatacactaatatatttttgtaggatattacataaaactgtagataaggatgtgtctaaataaattcatgcttaatttttaatcagtttaataatctagatattttcattcttttttttttttttttttttgagacagagtcttgctctgtcacccaggctcagtggcacgatctcggctcactgcaagctctgcctcccgggttcacgccattcgcctgcctcagcctcccaatattttcattcttaatggataattaccataatctagaaaaacaatgcaagacaattgcagacttttgttaaatatgaaaaagcaaggtaattctgtaccatttcatacctaaagtaaaaaaaaaaaaaaagaataacaaaaagttaactgtaccacctatttttattctaaatatggagcatagtattttatttaagtaaggaactgttatatgtatgcttacatttcctaagacatcttcagagcattacttttttcatgttcttaaatggctatacaagtagtgtaaatgttcaatagccagaattctgtatgtaatatatctaagtgttatatatgtatgcatatctaagtgcttattctctttccagagagattatgaattttcaggatttaggaagtccagttatattgcctcttgtgaccttgggttgtacacccactttgaaaatcagtttggcaatatgaagccatatgggagtagtgatgaaaaataaatggagaaaaaaccctatcttctgcttggtttactacctaacatttgggaatataatattaggtaaatatattcaaatatattgtggatcagaaagtgctgggtaagtggaaaataagaggtggcacttctgggcattttcttttgatataaccattttgaataaaccatttacacaaacatacgcatacaacctcttacctaggaacatcaaaactgaatatttaaattatgtagtcaggaaacatttcgactaccatgggccctaggagtctaaggcatgttgaaatgaataaaataccaatactttctggaagcattaaggaacctcatgcattcagtatttgctggaatttgtccttttggcattgaaaagagataatgggtgattacactgtcaaaacttctaattctcaaatataatcttcaaaggagtgcctgtgcagacataggcagaataattttaatggaccttgaagcatctggaaacatagaaagaaaccttgcatagcaacacaggaacattgctgatatttttgtttgttctctctctctctccctctctctctctctctctatatatatatatatatacacacacacactcacacacacacacacacacaaacacacacacacacacaagaatatattctgtgtggtcttgaatgagctattcaaagtctccatctgtcatttccatatctatggaatggaagtaattatgatgatacagcatgggtttagtttgagtgtgaaatcaggcactgcataaatggcacgcaaaagagtgcctggcaaatgataagtactcaatacttgtgttgggaagaccacaccactacatagcttcctgcctttcctcatcatggggaatagttccatatttaagagaatatgaaagcagtgaacagtatcttattttgaaaaaacttttcattatgacagatttcaaacatgcaaaagtagagacaatgagtgaatgaaggaatccccatgtgtctatcattcttattcaattatcaacaattatcagtatctacagtgttaagataaataatttgcaaaggtagtgaaaataccttggctcaaaactgaacatgttcagaaccccatatactttacatatctcttgaggtaatagatttccctatgtctctgtaacaaataaatatatttacctatattctgttgttagatagatgggtttgaggaaaacaaattcactaaatgcagaatcaacttttacaagaaaaagaaattataaatgaaaagcttttaaaattggttcagtttgcaaaactgatactaagaaaatatgtcaatacatttttcatcagaataataatattagctaaaatcatagattgcttctatgaaacaggcttagcatcatctcaattttcatagcaaccctattaattaaggaacactctaattatcattatatagatgaagaaattgaggttttgtaaatgtaaacaaattgtccaaggcaagtggcaagactagaatataaatccagggctgtctctagagattattcgtaaccactataacatatctcaaaacattttagtcattagcctaataaaccaagaataagaacgctatgaaaccttattttacttaaaaaaaagtttttttaaacttatttattttaattatatctgtaatgatacattttataaaatttataaatgtttaaaatgtcatccacatgggattaaaagaaaatcataaatctcatcagggacaaaatggaaggaattttttcagaccatttttctgttgaacacaatagaagtttagcttaaatatgcactttaattaccccatattttgattccttgatttcaacaaaaagttctgaggttacttagaaaaaaacctagcatactctaatgagattttcagtaaatagaaaaactctgtcatatatgccatacaaagacaaataaggttcaaagtaataaaatatgtcatccagcaaaatctatgctacagatttaatgatgatgacaataatttagccaaggccagctgctgtactaatagaccccaaatccttgtaatggcacaaaacaacagaagcttctttcttatttcatatagcagcatggggtggatgaataagtgtccatggacgctctctatgtagtcattcaagaacccaggtgggttggggctcttccatcttcaacagctgggttcctgaatgattgcatggaggagacaaccatggacgcttgttcatcagttcatcactagtagtcatcagtcaagaaatctaagaataagaatgccatggaggcagggttatcagataaaatgtagaacaacaatgctatatgtagaacatactagcactaaaatattattctgtatttacctgaaatttaaatttaactagattttccatattctgtttgctaaatatggcagcactacatgtaactatgtaagaaaaaaaaagaaactgtgcattaaccttttaaataaatatttttaatagtatcacccttaaatgcttagcacaatgctataattaactttagtcatcctgatatggaaaaagtagtgggataattatctcttaattatgtgacgaggaaagaaaatgtaattttgacctccccaagtgggtaaatgactaagattagaagccatgtccactcattactagatcctgcataatcttgcataaactaatatcaaatattttaacgtttgaaagtatgctaaatgtttatcagagcaggtgattttatttcattgagttctcatttactcatgtatatgttaatttatctattatgtattcaaaattactcaaatattgtattgagtgctctaggataaatattaataagtgaaaattaacactaatatatctctgattctttgcaatgtgtataattaattacctgaactggacactattgagagaaaagggatgcttttaataatcactccagaacaacaggggacagcttctggaaaacagggacaaataattattctgttggtccacctgattttaagttttccaataatagaatttcagaggagagctatcatagagctcatttaatataattgcactttatagacgaagaaatctgaggcccagtgaaaagaaataataatttctgtatattaatgtttctcacttaagtttatgacattttttaatgaagaatgattgatatgagactttttccatcgtatactcctcttgtactggaccaaagattgttgtcttctaaaacaatacgtacttcaactaagatcctaaagaccataattaaatcttaacacattaccaggtatctctatttattcttttagagcacaaatccactttttctaaacctattaagaactaagtatgtgttgcatgaagttttaaagtaatatttcatcttacaatccagaaaactcttttatattctaatggctctatgatgttgtagaacaaatgacatgtcattatttgaccgagaatggaactaaacccaaaaatggcccagccacagaatcttaaaatcttctattaatatggtctctggtaaatataatgagctgaaacacaacttctatggtatttttagagataaacattattttctcttgaaattctcacagtattcttttagtgcttacatgtcagatgtaggtttttaattgttaaacatgaaaaatactctgataatttaactactcctaaatttaagtgtatatatgctttcttttttgttcacagtaatgtaggagaagcagtgttaaatgatgctaggaatctgtactctagaaccggattgcctaggttcaaattctgatacaaaaactctatggcttttgaaacaaggcttacatttctaaccagcctattcatcactgttctcatctgtaaaatgggattcattatggtaataactacataatccagaacagataagtaaatgatttaattaatataaaacaattatcagagtgtatctgtcatgtattagacataataagcgtaagctttcatcagtatgttatttctttaaaaaaatccctcttttctctgccttataatttttggataattttttccaaatataaactggtaaattataaaccagttaaaatatcaggacattattgtttacaatatgtcgtttttaaaaactaattaagatcacattgcagtgaagaatgaccccatttaatatatattgacattatatttttgagcattttgtagattaaataaaacaaaaaaagatttaatacgaaacattttctatgtttgataaagttgcatgtatattatcactgttattttcttacctgttaaggaaaatattaccccaaatttaagttggaattttaaaaatgcatactattaagagtgaataagagtttatattctgcttgaattcctggtttatgacatacatacaaaatgagaaaggaaataaactctaggatgaatcttattttagtaagttaatggccttttcactgaaagtaggaaatatttcttctttcaaaagcacccaagatcaataaataatcttgatttaggaaatatgacaatgcaaacttttttcaaaatctgcttaaaaatgtaataaacaccatatcaatgggaatgtggtaataatcagaacaaattttctcaaaaatatatctttttttaagaatgagcaaatcaaatattttggactttattttttcccatggtattatcattaagaatatctaccccaatgtctgctttctccactttcatgcctaaactacagaacatcactggacaaaataataacatcttgctgatggggtccactacccatgacacttcagattagctctcagttggtgttttacagtattttatttccttgttttcattttctagtgactccattttacagttctttcagtgacttttctaaaatttaacagttctgagtgtcatcatactgcttctattccctctccctttaaccagatgatctcaaatccatcaatatggggaacattgaattctttttacttttttttttcctggttttgttctttagaagaacaagaagttcccttcaacagttttcaaccaaacatctgtcttcaagttacatcttcatcatctcaccatcctgaggattaaatgtgataatctatgtaaagcacttaacaaaatatcaggcacttaataataactattatctatcttttcccctagtgaatagtgggcaaagtttcaaccattgattatttgtttaaatacttttatttcagtaaaattgcttgcctttgaatatattttgccagtgctgaaaatcgtcatatgtcttctaatatccaaaaattactgaataaaatagtggttaggagcaaaggggcaggggccagacttcctaggcttaaatgtcacctttgccacttacaagctgtatgacaattgtcaaagacttaaacttgcctctgtatcctcatttggtaagttatttaaaaaaattatctctagtacagtaaagaagaagaagtatgataatatacacaaaatgcgtagaactgcctgccacatgctaagtactaacaatactagctgttattaattttcactgtgtctaaaattcattatttcagcaaatatctattgaaaccctattgaaaactaattgtgatgtgtgattttaaaggacaatgataattatattacttattgtctagacagcaaaaaaaaatacaaagatacaaatcaaagtacaaattatattaaaagctatgaggaagtgtcaggttatcagaggggatgttatcaaatttggaaaatcaggcaagctgagattcttagagtttgtaggtgctcattacaattttattttattttttctgatagtagtaataacatattttctgactatgataaaagccaaagtgttatctatgttctttacgtgaaagttcacttagattctctttctcatatggattatagattgtcccttattcaggaaagcaggacattttttggtctgaagagatttccctctgggtttcatttgtatcaaaagtgaattgtgaatcccaaaggcattcacattgtaagatgatactactagttgggatactgaggttccatttttattcctttaatagcttcctaattatagattccttttcctttaatttcagcctctatattaatgataaaactaatctgcaatctctctcaaataacttttatgctaaaagcaattaggtagatattttcttggctccttagagaggaaatagatttagatatgcagaaagagctttgtcattaaggacccaggtaactacgatcctctaacagttaatgacacaaggaactgggctcaagtagagacatatagtttaaagtgaaaacattttgacctgaaattccaaggtgcacctggtaattggtgaccttaacaagtggttatgacagcaaagtcctacagtttgtggaagatagaaagcaaattcactaaaaggaaaggtaagaggaggaagcaaagagaaagaatgcaacagagaagaagaaaaaagaataaaagttttccctaattaaatgcttactatcatccctttctcactgctattttataatattaattttatatattactaattaaaaactatataattatatacataattaatttttttctggttcttcaaaatatttgactaaataatttagaggtctcaaataaaaatggtaattttaagaccactgtgatcaagttctggaaatttttaaagatctaggaactttttaaagctttaatattttttgattatttttatattttatacaacatttttactaattccaaagaattataaatgactattatgtatttttatttggaaacattttggttatttgggaaaaagtaggtgttagtccagctatacattgtatgtttactgatggagaaaaaaaaaatccctcttgttattagacactgttattttactgatacccaaattctatatatttagatatggtttgggatgagctgtgtaacttatttggacatgtgaacatctttcactatatgttttgcatatgaaaaaaattatctcactttgccttttatttaatgattctttgaaatatattctttgtataaaccttataaagttgtcaaaattaattttcaattagaacatccataaaagtgccaagttattataactactgccttatgattcactcaaagtaaaggataaatccataacattttctattaattgaatagataatcttcattttacaaatgatttccatatagaattagtgttacgataggcagttcttagtgaaatcaatatcagcttatttcctattttgagtcatgaaccaaatcattgtcgtcatcattaaatctgtagcatagattttgctggatgatataatttattactttgaaccttatttgtctttgtatggcatataagacagggtttttctatttactgaaaatctcattagagtatgctaggtttttttctaagtaacctcagaactttttgttgaaatcaaggaatcaaaatatggggtaattaaagtgcatatttaagctaaacttctattgtgttcagcagaaaaatggtctgaaaaaattccttccattttgtccctgatgagatttatgatttttttaatcccatgttgatgacattttaaacatttataaattttcatgaaaaccattttcatatctgttaatataaattactctatcaataattattttttgtagcaaagaaaattaacaatactttgccatttttgttcactttggcctcctcctgatgtcattcttcattttatccacatttcattaatgtgcattttataaactatgctaaaaatagcctcttttgaccacatgtgactgtgactcagaaagtttacttgcatctgtgcttcaaatgactaaacatttttggtttctataatggcaggtgaagggaattaaagaagaggtaaagtaaatattttaactggtgtataatatggttagatcatcctgtttttgtgccttccactatgatttgattacttctaagataaatgatttcgagcatatttgacgtgcaaatatatttaagattcaactatcaacatttgcttagtaattaaaaatttagtttttcaaaaaatgctgagtgccattttgtagctgcagatgaaatttcctaatatcgggaaatgaattgtttttatttgtttgtgtgtctgtttgcattttcccatggcttgctggtgcttatactttatttttcctcaattataaaaatattgttctaaaagagaccttagagttctacacagcaacccacttacacagctcaggaaacatgggccaagagagatgaatgttctgcttcttcagtggttcttacccctgaatgtttgtggtaatcatcggaagcacttgagacccaaggtcagacttctaccactggcagctctaaaatccaagttcggggtgggtcctgaattgtaatttttaaagtcataggtcactggaatggtctgtcaaggctgaaaatacctactcatgcatttagtcttatagaaaggacataagggttattgtgatttcttactagtagaattgaaattagcattaaggcacttaatactcccttcactctaatattctgcctctgtttttttttttttttaatggaagttattctacttgcagacactcgtttttttttttttgtttttttgttttgttttgttttgttttgtttttttgatggaggctcattctgtcacccaggttggagtgcaacggtgcaatctcggctcggctcactgcaacctccacctcccaggttcaagcgattctcctgcctcagcctccctagtagctgggattacaggcgcctgccacgacgcttggctaatttttgtatctttagtagagatggggttttgccatgttggccatgctggtctggaactcctgaccttatgatcgacccgcctcggcctcccaaagtgctggtattacaggcgtgagccaccgcgcccggccgacactcttgttcatccagaaatctggtcaccagtttccttgccagtatctaccagcccattctgcaattctgacggaattattaaactcctctgtgccctaggggcactattgccttatgcacagataacatctaggagacactggtttttttttctggtatatgtaacaaaaaagtaacaaaagcaaattgctgaattgccgttacaatagtacttaattaatatgtatgtataactgtatatgtgtatatttatgtacttagtgtttctgtatttgtattgtttttataggaaatgcactgattctctaatattaacacaaatcctcttcattcaataggtgttaaaaatctctaacacacttgtcagtgctctcagatatgagtatcttttcattgtcaagtcgcagattcatgtctgatttcagaactttgtaaggccagtgaaagtgagtgacgaaggatcatttaaagacaaggtacaaatagcttgtagatatgtttgtatcatataaatttactgtttatgtggcattttgagatctcttacccaattgacaccctttggcaatgaaagtgaatccttcatttatccactggttttatttattcactatttttcattcattcaacatttattgagcattcactctgtaccagatgcaattctaaaagctgggaatacaaaagtagacaaaagtatacctcattctggtcctcatcacacctaatagctactggtcaagacagacattaaatatcatccaaataatcataaaatttactgtggtgagtgcaataatccagggatctaaactagtctgtgcaggagtggaggtggataaaggcccaggggcaggtaaggctctcctgagaaggtggcatttaggaagtagtaagtaggcaaagaggctgaataatagttcccatatgaagagagaagaataaatgaaaaggtgttggcactttcaaggaactgaaagaaaaagagggaaactggaaagtgacatttttacaagtatttgaaacctttttttttcatgtgtaaatgtgggattacttttacctttgcagaaataatatattggattgtaagagttgttttcctgaaggtcatcaaaaattagaatggccattttcctaatttgtcttattatggcagtctcagtattaacaacaggtccagccctctttcagaaaacaaaatattaatagtgacctttttactcctaaatgcattctagtttggatagtaaatcttatggttagcctatctagaataaaagaatatactttacccaattcttaaagttgcaaaggaaggaattctggtaaatgcatacataggaaagtgtagccttcttactttttgttttgtataatgtcttggtatagggaaaataagctaccaaataaccaaccaacattttaacttctcttattttcttccttttttccttccttttcttgttacttttcaaagtgcaagtaaccaatattatggaatgtctaccttatgcatggtgcagtgccaggcaatgggtatgtagtagttaaataggcaggaattagaacaaaaaaaaaaaaagaggaaacaagatgaatttgagggggtgctttgagagggcatgagagcagctataatatgtgctctggttaggagaagaaaaacatagtatttttaagatactgttggagactagtgaccttttcttaacgtttaaaaatataacaagagagtcagttttttctgattcttcatgtcctaagacacaagaatctcttgggcaaggtaggatcctccttggaggacagaaattagaaagtctgaatcagaatcctcagtatttggcagagggaaagaagatactggggaaaagagcatggcttattttcttttcatggtgacactacttttctattgggttgcaactaaatttgggaggttgacacagtatcataaaagcaaagaaagatatccagccctatagtctttttttttttcttttatgatgtaccttcctaggtcaactgagttttgcatattcctcattgctgggactgtagtcacctctctttttattctcactacaatgggaaataactgtcttcagatatcaacagtgtggattccttttaggctagatttcccacacttaaatatcctagtgttatatcagggacgaggagacaagacaaagagacatgccattttcatatttatatttttcccctctccaattctttattttccctccaattccagaaaactcctagcacttctcaaatgggaacatattaaaatcctagcaagtattttaaaaattctattgatagtctcaaggcttcagctttcggaaattaaaataattttgcttctctatttggttcttctttctttttcagtaaaagcacctacttgaagacatagagatcttttcccctactaagttgcccaacaggagatgatcagtttaaagaaaatgtggaaatacaaattcaatctgtaatgcatcacctggttttttccaacacacaagtaattgacctctttatattctgatttaagttcctaagtatttgtgtttgacaagatctgtagtgtctgacatagggcatcctcaaacagcacggtgccaaaaaatatggggtcagaatggttgggttttaattgtgactctgatagttactgattacggaaccttgggcacagtatttaactagtctatatatctgcttcctcatctgtaaattggaagttattataaagccttccatatagacttcttatggaaataaaatgaaataattcatacgaataccctggcacatattaggtactcagtgaatgttagctagtattacaaatgtctatgacaatttaattagcatgatgtctagaaccgccattatttgattagaattagtttagcaggaggatgaaaaaactgagaaggaccctaaaatgagtagccatgctgttttatttactcctttctttatttaagacatgaacaacactctaggtacagttttatattttaatggctatgttgtcttctcttcgtccttacatgaaataccctcaccctctcccccagaaaaaaagaaaagaatcattccattgttagaatgcagtttagagattataaactccaaactctgtacgtcattaaaatttatattcactgggaccttgaacttagtcttcaacttttacatgcaataccattagtttatttaagttcagttgattcactgtttgtctccctccacaaaccaacctcttgcatcagatgttctccttaacttgcttagaggcctgccatttctttggatttttttttccattttatcacctgaaacctcatttccatcttaagtaggcctcccatgcattgtctaagtatctccctaataattcccaacattttcttgtcccaactgcagcctagttctctctttaatagaattgttttacatccctctcttgttgcagatatgatttctctccaactccgtatgtaaaaaagataaggtgaaaagaggatattgtgagcaactcagtttcccttgccacttcccagattggtagtccaaccccttctctgtgtctattccctccagccatgctactattaatttattcttgtggtctccttgtatattcacagaggactttgcgttgtggctcatagtcttcttgttcaccataatttatgacatcatgagggctccttaagttttcttgagccttttggtattaacgtctgtcaatcccattctgctttagcaaactcactgtctgccatcacttctgggttttcttcctttgtttcctttgttctgcctggaactcactgcctttccaacattttcattgtctttatcccattctgcatctgtaccattatccctaaaacttgtcttcatctaataatttacttggctagtactatcctgagaagtctattagaactgctactacaaatttatggtcttaacttttttttttttattattatacattaagttttagggtacatgtgcacattgtgcaggttagttacatatgtatacatgtgccatgctggtgcactacacccactaactcgtcatctagcattaggtatatctcccaatgctgtccctcccccctccccccaccccacaacagtccccagagtgtgatattccccttcctgtgtccatgtgatctcattgttcaattcccacctatgagtgagaatatgcggtatttgttttttgttcttgcgatagtttactgagaatgatgatttccaatttcatccatgtccctacaaaggacattaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccagcaacagtgtaaaagtgttcctatttctccacatcctctccagcacctgttgtttcctgactttttaatgattgccattctaactggtgtgagatggtatttcatagtggttttgatttgcatttctctgatggccactgatgatgagcattttttcatgtgttttttggctgcataaatgtcttcttttgagaagtgtctgttcatgtccttcacccactttttgatggcgttgtttgtttttttcttgtacatttgtttgagttcattgtagattctggatattagccctatgtcagatgagttggttgcaaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaagggagggatccactttcagcttcctacatatggctagccagttttcccagcaccatttattaaatagggaatcctttccccattgcttgtttttctcaggtttgtcaaagatcagatagttgtagttatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaatcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgccaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctggattcggtttgccagtattttattgaggatttttgcatcaattttcatcaaggttattggtctaaaattctcttttttggttgtgtctctgcctgactttggtatcaggatgatgctggcctcataaaatgagttagggaggattccctctttttctattgattggaatagtttcagaaggaatggtaccagttcctccttgtacctctggtagaattcggctgtgaatctatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattatgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccgttattaatgtgtgggagtctaagtctctttgtaggtcactcaggacttgctttatgaatctgggtgctcctgcattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatggttttcctgaatacagcacactgatggatcttgactctttatccaatttgccagtctgtgtcttttaattggagaatttagtccatttatatttaaatttaatattgttatgtgtgaatttgatcctgtcattatgattatagctggtgattttgctcgttagttgatgcagtttcttcctagtctcgatggtctttacattttggcatggttttgcagtggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacctgacctttctctctggctgcccttaacattttttccttcatttcaactttggtgaatctgacaattatgtgtcttggagttgctcttcttgaggagtatctttgtggcgttctctctatttcctgaatctgaacattggcctgccttgctagattggggaagttctcctggataatatcatgcagagtgttttccaacttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgatcgcattggctcctgaggcttctgcattcttcacgtagttctcgagccttggtttgcagctccatcagctcctttaagcacttctctgtattggttattctagttatacattcttctaaatttttttcaaagttttcaacttctttgccttcggtttgaatgtccttccatagctcagagtaattcgatcgtctgaagccttcttctctcagctcgtcaaagtcattctccatccagctttgttctgttgctggtgaggaactgcgttcctttggaggaggagagacgctctgtgttttagagtttccagtttttctgttctgttttttccccatctttgtggttttatctacttttggtctttgatgatggtgatgtacaggtgggtttttggtgtggatgtcctttctgtttgttagttttccttgtaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcaggttctcagatctccagctgtgtgctgggagaaccactcctctcttcaaagctgtcagacagggacatttaagtctgcagaggttactgctgtctttttgtttgtctgtgccctgcccccagaggtggagcctacagaggcaggcagacctccttgagctgtggtgggctccacccagttcgagcttcctagctgctttgtttacctaagcaagcctgggcaatggcggacgcccctcccccagcctcgctgctaccttgcagtttgatctcagactgctgtgctagcaatcagcgagattccgtgggcataggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgctcacccactggcctgcgcccactgtctggcactccctagtgagatgcacccagtacctcagatggaaatgcagaaatcacccgtcttctgcgtcgctcacgctgggagctgtagactggagctgttcctattcggccatcttggctcctcctggtcttaacttttatgaactcttatacagccacttgtccaattttccaaaacagcaattctaaacttttctctccagctaattattaaacttaatatcctatcctgatgctattggaagattgtcactccagagaccctccagaaacatgatcaatccaacaatagcatgcaattgcagcatcaatttttagaaagccagtttttcttctgtgtgtgtgtgtgtgtgtgtgtgtgtgtgtgtgtgtgtgtaagttgcttgaaaggtagtcagctattgatagaacttgaggtgagaatttaactggggtttggttgctaccagtacagcatttttgcagcatcccttgggttcattggaactaggaaataaagagtatatatattatctaaaatagagaagaattgaggataaccgtttatccatttatataatgtgtagctaaaatctctctcatatctccttgaactgagaaccaaaatgtttttactaatttatttatttaatgaaatgtattatttaaataaattgtaatgtgtgtatttaaggtatacaacatgatattatgggatacatatagatagtataaaggttactgcagtgaagcaagttaatatatccatcatctcacatagttacccattagttttagtttgtttttgtggcaagagcagctaaaatctacttatttagcataaatctcatatactgcacaattttactatctacagccttcatttgtacattagatctctacactcttgcatcctacatatttgctactttgtatccactgatctacatctccccattcctcctgcctcctgccccttgtaactactcttttgcgttctctctctctctctgtgtgtgtgtgtgtgtgtgtgtgtgtgtgtgtgtgggtttagatttcacatataagtgagatcatgcaatactttcctttctatgtctgacttagttcaataagcataatgtactccaggcctatccatgttgtagcaaatgacaagatcttgtccttttttagtggcaactcaattgtggaaaaacaaataaactgatttaaaaatgggcaaaagacctgactagacattttttcaaaagaagacattgaaaatggccaacagattaatgagcaccattaatcatcagagaaatgcaaatcaaaaccactgtgagataccacctcatacctgtcaggatggctattatctataagtcaaaagataaggaatgttgaaaaggatgtgggaaaagggaactcttgcatgctgttggtggcaatgaagattggtacagccgttatggagaacagtatggaggtttctaaataaattaaaaatggaactaccatatgatcttatgggcacatacccaaaggaaatgaaatcaccacctcataaagatacctgcactcccatgtcatgttcattgtagtgttatttaaaaaagctaggatatggaaacaactcatggatgaacagataaataaattggtacatatatataattttactaatttcaaaggcttattttctaagacaaaatttaaaggggcagtttcaccccagatatgcccaatggaaactagcaagtgtgtgcatgagagatgactggtgccttgccacaatggcatgtaccatcatcgtttgcctcagctatggcaatagcttccctactagacttccagcttctcccctcaggccctccagtccattctccacactgcttccatatcctcctttttagataacaaaactgataatagcaggcctttctcattagtgattgggaatttggtaaaatgaaggtttctggactacatcctacggagttagattgtaagcttgttctattaatctgtgttttaattaagcattctgtggttttcaattgctattgctccacaagttatattttgagaaaacactgacccacagtatgatatcaaacatatgtatgcatttaaaaaaaaacctttcaagatctgttctttagtatcattttttactactggcccttaggcatcctgtgccttagccatatgtattactcatcttcccatgtcctgtctctcctctgtgcctttaattatgctctactgtttcttttgctcagaatatctcctgttctactgctatctgagacgcgttctttaagtaacctagccaggttagacacttgtcctctaccgctctagctttgtcttcataatccttgcaaactagttttcacattgtcttgtaattatctctctctcccctcctcacctgtgttgactgtggtcttcttaagcaaatatatacaggtcactgctttcatcttctgtatctgccacactgcctggatagaggaggcattcaattcattattgctaaggcaatgaatctatcttcaaatctgtatgtctcagattccttacctgtaaaataaagattgccagagagactttttcaccaaacaaggtcttattgatccggctcgcttgcgcttgctcgctgtctctctctctctctctctctctctctctcacacacacacacacacacacacacacacacacacacgtggttcaatatattttaagtttatactgaaactatttaaaataaataactctatagaatatataaactattagttatagttttcttttgctttttaaacctagtttgtttcccaaagctaatgttagataaaaagataatcaaagtagccagatggtcgttaatcatgagggctttttattctataaacataaaaattccatcacctccgaggagtttcacatgtatcttggattcatcctaatgtggggtatgaaaaattggtttcaattcagatgtacgatttagatcacttacctttttcttccttatttttcttgagtagggttgtgagaaatggctcaatgtaaaaggcataaacatagaattcttgatgtaaatggatgtagtcagcctcaatctaattaaagatttctctctttcctttaccctttgtcagtatctttgtctcttgcttctagaaattaaattggaaattttactatgtttctgtccttttctaacctttacttttatttgctcacacacatatgctaagatgcacacagatacacagagacacatacagtgtaatttgcagataaaggaattcacacagaaaacatatatagggtgaagttactttgtatagtataattaccatggtaccctctactctacatttcctaatttatctgaccaacttggcattcaatgtgaagtatattgtgtgagttatgtctattaatacattatgacttataatttataaaccacctttaatgcaaagcaaatactatttcaaggggaaaaattgcatattcaatttttctttatttatacataccctaggatttacttacacatggatgatttatagagatttccccattgttttaaagtaatttatggcaacattcctttatctaatgaaagccaagcaaagggaaacaaaaccaaaaccccttttgatagagaaatgctgagtgagaggtactaggaaggggcacgaaaaagcatattctatggcttaatgctctaggcttacaaaagcatggtgttggaatggtaattggatttctgagcattgcttttgtgaatagactgcttaaatcattgaaaaggaaatcattgcagaaaagaagcagggaagaattgcacaggctgtttgagtacttacaaactaagaataacatacgaacaatgaagaactggtttagtgctgttgagatttgacatctttaaaaacctgatattgtagctgtagttttgatcttcgttcctttgttgaatgaagtcccaatgcattttggaccagtactttcaatgagggctgaaacaaatgagatttttaaaatgctttttccagaaaaataaaattttcccccaagtccacattatatttttgtttgaaaaacacagatacagatacatatgcatctctatttttagtttgtttcacatgtttatttctgcggtggttgacttgccattcttaaaatgttaaaagtcctctatcctcccaaactttcatgttaatagagtgactgtcacactgtaagcattcaaaaattattttgatgtgctagaagaggcttgggaattggaggtggtgtctgggtgttagcctcttaaatctgcatgtaaatttcccatcagcaattataaaaggaaaacatgtcatttactagacagagttaaaggatgtccactatctgctttttcaacaatacctatccactatcactggggaatcgtgaacatggacacaatttttaccttcagataacttatacgtattgcccctctgcccagtttttgcattttactctgaaaggtgcagaaagaaacaagaaaagataggaaatagacttctaggagagtttgcttaaaaaaaaaaaaagagttccatttttcttggagataatacaacacagatttttacttgtccttgttaaatttgccacagaagataaaacatttgttgagtgtgtaattccatgctaaacaacttgctagttatattaatcatatattaaatatattggtcagaataaccctccctttattttatggtgagcaaatggaaaacatagtgataaaaatttttcagggtcaccataactagaatttcaatccagttcttttggactccaaagcatatattttcctctaccgtgcagtaatttattttaaacattagttatttgaagacaattgaagtactgtatacttttctttggggaatattcattgctttatggaatttcttttaatttttgtactctgttgttaagttcaaatacaattgtacttttctctttgttcaaatagaggaaagaaagtcactcacaaagtggcaatgtgcaaaggactacaaaaaacatctattctccatctgagacctagctttatagagacaataagaaccactgggaggaaaccagtgagtgtcagtggtttactctagtgtaaaacatttggctctggaaaaaatcatgttttttataaaattgcacagcacaagacacagaagcactttttataaaattatgaatgacaattttgaatttttaatgttttaactatttatttttaaaacatgccttactagatagcttcagaatatatgaataaaaatatgtaaattatttactaacattcaaagcagattatggtggtaaggaaaatgttcctgtaatataaccttcaatagcaggtgttaatttcactgatttctcactgcttatttagatggaacagtgccttccataccgtcaatgacagagtgtgagtcccacagtcactcagctgggcttcataatgtcctacttatttcctgtgttatgtgaggtttgtcacttaacattcctgagtaagaattcttcttctgtaaagtagggcactaataccgatctcataaaatctctgggagaattagctgactgatgtaggaatgtaataatggtagccagcttgtcctgagtacttacagtgtgcctgggatctcctcagatttacaggcattagcatctttagccctcacaacagcctataaggttttactgttaagcctccttccactggggagacaactgcaaggcaggaaggggcatcataaaaagataggagtgtcagaaccagtgctggaagccaggcattttgactccacaaattgtgcacttggccaatatactatactatcctgactcccaccactcaccacaaagttaggatttttttttcgttcatggccaacaggtctatgaaaaattgctcaatatcactatgagggaaacgcaaatgaaactacagcgagttatcaccccacacttgttaggatggctattatcaaaaaatgaaacaaaagatagtcctcctatctaactgaaattctgcatcctttggccagcattttctcaactcctactaacacaaccacccaagacctttgtaaccactattctgttctctagttgtatagtatcaaccttttttgattccatatttgagtgagatcatgcagaatttgtctttctgtcctggatgaactcacctacaataatgtcctccaggttcattcatggtgaggcaaatggcaggatttcctttttctgtggctgaatagcattccattgtgtgtctttaccacattatccattcatccatttatggacttttaagttgatttcatatcttggctaatgtgaatagtgctgcaataaacatggtagtgcagagatctctataacatactgattcatttcctttggttatatacccagtggggggattgctggataataagaaaacaagcattggtaagaatgtggagaaattagaatcctgtacactgttgggaatgtaaaattctgtagcagctatggaaaatagcatagaggttcttcaaaatgtaaatatgggactaccatatggtttaacaattctacttctggatatgtatccaaaagatttgaaaacagggtctcagagattgtttgcgctcccctgtttgtggtagcatgattcataatagctaaaacatgaggtataaatatagaatggaatattattcagcctttaaggaaaatcctgtcatatgcaacaacatggatgaatctggaagccattatgctaagtgaaataatccatgcaaagaaaaacaagtactgcagtatttcacttatatgaggagtctaaaatagtcagacttacagaggcagagaatagaatggtggttgccaggagttgaggggaggggagaaatagggagctgctattcaatacctgtacaaattatacgtggttctagaaatctactgtattaaatcatgcctaaggtcaataatactgtgttgtatacctaaaaatgtgttaagagggtagatctcatgttaaatgttctcaccacaataatctgcatgggttgaattgtgtcccccagaatgatatgttgcagcactaaccctggtacctcagaatgtgaccttatttagaaatggtgtccttgctgatataattagttaagatgaagtcatgctacagtaggctgagttctacatccaatatgcctggagttttataagacaatgtgaatttacaaaggaagatgccacgtgatgatagaggcatagattggaattataaagttgcaatccaaggaataacaaagatgaccagcctcctccagaagctaaaaaaaggcaagaaaggttcctacccagagtctcacagggagcatggccctactgacatcacaatttcagacttctatcctccagaactgtgaaacaacacatttccattgttttaagccacccagttagtggtcctttgttatggaaactcttacacacatacatatatatatgtatatttaatagatattttaagaaatattaagcaaagtattaggtacaataattgctcaaaagcgattgttcctattttatatagtctaatagtggggaagtctgtgcttatgggaaacttttaaaaacatcaaacacttcctgtgtgtaatttgctaaagttaaaaatctgtaaaaccacagtgttcttgtgtagtccttcaggagacaaatatgtgcctttcttgacatggaagtttctttccacctcagccagtagcacattcactccaaacttagcattcatcatttatggcaatcagatcagtatttaggtctatattgccttgtagtatttatttttattttaaccatcttattttctttatgtatgtagattataaattcttagagggagagaattatattttatagttttgtaacatagcacctaaaacaggacgatgtttgatatggtttggctgtgtccccacccaaatctcaacttgaattatatatccaagaattcccacatgttgcgggagagacccagcgggaggtgattgaatcatgggggctggtctttcctgtgctattcttctgatggtgaataggtctcacgagatctgttgggtttatcagggggttctgcttttgctccttcctcattttcccttgctgccaccatgtaagaagtggctttcaccttccaccatgattctgaggcctccccagccatgtggaactgtaagcccaattaaacctctttttcttcccagtttggggtatgtctttatcagcagcatgataatggactaatatatgtgtgcatgtatgtgtgcgtgtgtgtgtgtgtgtgtatgtgtgtgtgtatatatatatatatatataataccatgtgtaacatttgaaaatatatatattcaaatttcagtctctggcattcatactgaaatttgtttgtgggtacctcaattggtcagcttaatgatgtcttcccttctcaagggaaggtaggtatattagttttctagagctgccataacaaagtactacagactgggtaacttaaaacaacaaaaatgcattgcctcactgtttgggaggctacaagtccaagatcaagggttggcagggctggtttcttctgtggatatctccttggtttgttgttggctgtcttctcactgtattgtcacatggccttccctttgtgcctgtgtcctcatctctactttttaaaagaacactagtcatattagattagggcccaccctaatgacctcattttaacttaccccttttataatccatctccaaacagagtcatattttgagatatcgggggttaggactttaacatatgaatttgagggagacgcaattcagcacaaagcacaaggcataaataacttgtttttgtacagattcttagctaaggaactacctttctagaaagccctgtgaaatattcaaaagtatatgaggtgacagatacatgaattagcttgatttaaccatttcacaatgtatacaggtaccagaacatgctgcacactgagaatatatttcatttgtacgtgccagttataccttagccataaattcatgtggatagataacgtttttctttaaaagcaaacttaaagaatattaatcaaagagtattcatatcaaataattactgacagtgttgttttccaacctgataattttcttgaggtaagaaaatatagatcacggctgacttcagcctcgactacctgagctcgagtaattctcccaactcagcctcccgagtagctgagatcacaggtgcacaccaccatgtctggcaaattaaaaaaatatatacatttgtagagacaaagtcttgctatattgcccagactgaataatatgcttgatcaaactgctaatattgatttggatttgaatatagtaatccctattatttcaagtaataatatcttcaaagtaatgaatgcaaaggagataaactgatatttgaacacactaacatgaccatttcaagaatatgacatgacctcttcaattgctccattcggcttttagatggaaggagaatgcattagtctcttacaggatgtactgtctttatctgaggaactttgaagagtatgaaaaacagctactagggaaaaaagaaagcttttatattctttgatgtggaggattctgtgattctaacactgtgattatttctttctgtaccagagcttactagcctacacagatattagaattcatagctatatgtaattcaaatttatttctgtatgtgagaaggaatgtgattcccttctctaaaaatcatttactgtatagacataacataacattatccctctattattggtagaaatattacaaatcttggatgaaattttttctcaaagcacaaatttatgctgctaaatatattgattcagatcagtctccaaaaacaacactaaataattagtagttttcagaaattttagagaaaaaagggaaaaatattcagaggggactttttaatgaactctagagacatacattaatgtaagtaactgtaagtcggtgatgttccacaattactttttactacccaccatataacaagattggatcatgtgaagtgctgtgcttaaaacttaatcttaatctcaacatatcacagaactacatttgccttgtttgccagtaattgaatattcagggtaatcactaccatactcaccaaagaaactaaggccagcctctctttcctgaatcttactagattgtagttctagaattggccttttctttcactcctgaaaataaggcattgaactgtgtttcagggcaggacccagtctttcctactcaccctactgtctctagatttactcagagctgtcccctgatggagatgcaggattggatagaaaggatgctttcttctctagaaatatggttgttgtggattaaaagtgtctggaggtgagggatagaagacttcacatagggtacagtgtatactgctcaggtgatgggtgcaccaaaatctcagaagtcacctctaaagaacatattcatgtaaccaaacatcacctgtttcccaaaacctattcacgtaaaaaaattagagattcccaaatccatttccagtaagtctgaagtagttgatctaggcaatttgaagaagattaaatattattaaatactctagatgattctgatatggatgactaagagccctactccaagacaggctcagaactccagaatgctgacagctgaatgaaaagggaacatttgcttctcagtagaaaccaagcagtattgaagaggtagagggctagagaggaagccaagaataaaattccttaaaaatgaatgggtgcttctgatccaaaatgatttttcagaatttactacatatataaggcagcctatccccttttttatgagatcagttttatattgggaacttctcacattatcatgtctttaaaaaacaaacaaaaaataaaaccttcgcagaggcactaaaaagagagtgtcttttcaacaatcatgggagttttttttttttttttttttttttttttgaagttttaagctacttatttattgtttgggaagacagtggtggatgtacttcttggaacattttaacttagtttctaaaacagctttattggggtataattgatataaaaacagcatacatatttaatctatataatttgatgagtttgaacatacacatacatctgtgaaactttactgcaagattataataaacatatccatgactctcaaaagtttctatgtgccccatctcctattttgttgtaaggacatttaacataagatctaccctctaaacaatttatttatttatttattttaataatttcaagttttgttttagatttaagaggtatatctgcagatttcttacatgggtataatgagtgatgctggggttgctgcgattgaacctgtcacccaagaagatagcatagtacccaacagtttttcaacccttgctccctcctccttacccccttgtagtagtcccaatgtttattgctgccatttttatgtccatgtgtgtccaatgtttagctcttacttgtaaatgagaacatgttgtatttggttttctgtttctgaattaacttagaatgatggcctccagctgcatccatgttgctgcaaaggacgtgatttcattcctttttatagctgtgtagcatttcatggtatatatgtacaatattttcttcatgcaatccaccatcaatgggccataggttgatttcatgtctttgctatcgtgttgtgatgaacacacaagtgcatgtgtctttctagcagaacaatttactttctttcagatatctacccagtaaagggattgctaggttgaatggtagtcctaagatctttgagaaatctccaaattactttccacagtgactgagctaacttacattcccatcaacagcacataagcattcccatttctttgcagcctcaccagcatctgttgttttttgactttttaatagtagccattctgactgggatgagatggtatctcattgtggttttgatgtgcatttctctgatgattagtgatatagattggatatttgtccctgcccaaatctcatgttgaattgtaattcctagtgctggaggtggggccaggtgggaggtgtttagatcatgaagatagatccctgatgatttggtgctgtcttcatgatagtgagctcttgagagatctgattaaaagtgtgtggcacttctccttccccctttctttctctcgcttgcacctgctttcatcatgtgatgtgctccctctttgcctttcaccatgattgtaagtttccagaggcctccctagaaaccaagcagatgccagcatcatgcatctgcagaactgcaagccagttaaacctcttttcattatcaattaccttgtctcatgtatttctttatagcaatgcaagaacagcctaatgcaattagtgatgttgaacaatttttcctgtatttgttggccattgctatgtcttctcttgacaagtatctgttcatgtcttttgcctcactttttaatggggtgattgggttttgcttgttgaattaactttcttatatattctggatgttagacctttgtcggattagttgcaaatattttcttccattctgtaggttgtctgtttagtttactccgttgataatttcttttcctgtgcagaggctctttagttcaattaggtcctacttatcaatttttgtttctgttgcaattgcttttgaggatgtatccataaattacttcccaaggctgatgtccaggattgtgttttctaggttttcttctaggattattttacttatttatttatttatttatttagagacagggtctcactctgttgctcgtgctggagggcagtggcacaatctctgctcactgcaacctccacctcctgggctcaagccatcctcctgcctcagcctcataattagatgggactacaggcataggccatctcaataagctatttttttaaaaattttttgttgagccgaggttttgccatgttgcccaggctggtctcagattcctgagctcaagtgattcgcccaccttgacctcccaaagtactgggattaaaggcatgagacaccgtacccagcccttctaggattcttatagtttgcggtcttatatttaaatatttaatccatcttaagttaatttttgtatatgctaaaaggtaatggttcagtctcattcttctgcatatagctagcctgctattccagcaccattgattgaaaatgaagttctttccccattgcttgtttttgtcagtttcgtcaaagatcagatggctgtaggtgtgcagctttatttctgggttccctattatgttcccttggtctatgtatcttttttttttatcagtaccaacgtaggccttggttactagagccttatagtatagtttgaattccattaatgcaatgccttcagctttgttttgttttgcttaggattgctttcgtcatttgggctcttttatgtttccacgttaattttagattttttttttaattctgtaaaaaatgatgttggtagtttgacaggaatagtgttgaatccatagattgctttgggcagtatggttgttttagtgatattgattcttcaaatccatgaacatggaatgtttgtcgatttgtttgtgtcatctatgatttcttgtcattgtgtgttgtaattctccttatagagatctttcaactcacaggagtcatttttattccagcttgctccctttttttctgatgtgttctcctttctgcctggtaggaatgttcctgctgtgtacaatacaggggatgtgtttagaggtggcaaacttgattaaatatatactagaaataaataatacaaacaagtgcacttagatagaagacttttccaatctgtattttgtctaatataagcattcttttaatttgtcttttggatcatcatttttgagggaatcttattccaataagctacatgcatcatctgtcattttgttttcaggatttattttctgcgtcatggagattagcttaattgtgatagatattttgttgtttttttcatatatatgattttcttttgctcatcatttctattgatctatgctcctgattttagtaattaaaacacagttcagtatgctagcattttcttcagccaaatttaataacctgtcagattcttatggtcacaattaagagaaaggtgtttgtaagtgtgttaatacttagatttctttataattaaaaaattatttgattggctatgctggatttatacttaataatcctttgctcatgcatgtcggtaatcttcactggttacccaaggttcaaacccttttaactagtgtaagcataatgatatgtgcagttataattggtttcagtaacaaaatttaagtcagaattgtagtataataaaatcacagttaattcttaatatctccatattattttacatttgtaagtcattatgattaaggcagaatgttggagcttactgcaaaatttctttagaaagaaaatacttttcctaagttcatacagacaagtttagatattagagtttgaggcaggtaataattggaattcttcagttcgctgacaatattgatatttattttcataactttatgcaaatattttctttaagtactaaaaagatgtaattgataatgttcacactggtcactttcatgacatctgaaattttggcatgtccctaactttgtgagagacaaaatggtgaagtgattaacagcaaggggctaagttcaaattgtgactttttaaaacttcagtggcttctgcaaaatggagaaaaaaatcgtttgtactttgtacaggattgatttggagggattgaataagatgcaggtacatagaaatcactcaggaaatgcagcaactcttataattaatctgctatgtgtcccagcccatagtaatgactgattagttttctgtacctgtaattttaccttggcaagaatgttataaacataaacctactctcttaagtcttgcttcttctttcactaagcataatgcatttgagattcatctactttgttccttgttccacatattaatattattttcctttttatgccaagcagtattctgttatatggatatgacacagtttttttattcattcctgtttgagggatatttgagttgtttccaggtttggaggattatgaacaaagctacattaagctacataatagctacataaaagtttttaggtgaacataagttttcatttaacttgatttaatctctacaagagggatttctggtttgtatggttaagtgtatgtttaataatataaaagaaaaaaatccttattcccaaagtagttttactatttttcattcccaccagaaatgaatggaattttccattgttccacattctctttgttacttactagtttcaggattttgtttgtttatatgttttgccgatctaataggtatgtagtagtggtgtatttttttaataataaatgatactttaaagcatattaatgtataaaacagtctttaaactaacttggaattataaatttgtacattttcttttaagaagacttcacattttcttctttagatatttccaggggagaaactttttgtgtttaattttattttctgtgctaatgtgagatctctacagattcaaaagtaaataagaaacggtttctgatttcaagttgttcataatttgtcaaaggcactgaggtggagcccaaaattttggcctcggaatatattggagagaaaacagagtccagtgtagcaactgaatggataaatgttgctgattggtgaataaggattagaaaagtagttgtgatgttcataacaataaagtggaagaaagctttgaaaggtcagatttagagattgaaaaataattttatttttgagctagctacaaaaatgtttattcttttgagtttgctttaaagccctcaggcatgaacgatcatgtatttacatctgtgggaaaggtggcatagtgaactgtcggagctagaagaaccaaaaagaggaaaagagcagtgcactaaataaatccttagacctatgtcaaatcagatcggcaaattttgttcacattatgattgatttaagtatcaataatgtttataaaagtttagtagcttatctaaattcaaaataggggttttcattgttttctttagacatatacgtcaattcctcatcccactgcccatggcaattcatatctcaggactagtattggggcatttgtaagattggctttggaaattcctctctgggttataatttatacaatgctttgcccacagccacatataggtatatttattcccttgttcacatcataaaaatgagctgaaattaaacattaagtagaaaatatgagaacaatgaaatgctatttaaacaaaagggaatatcactgaacatttggataacagggagcaccaacaaaggcaaaaagaaagaaatggaggaagaaccatggaaatgcatttgggatgtttgttactctcctatgtggttttccttttctatctcctctaaaatttaaattttcttgttatactcatttttgtgtaaatatgaaaaaagattataaatatacatcactgtaataacatagctaaatttaaatggtaacaaactattttatggctgttcaggttttaaattaggatcagtttatgttagcacttgcaatttgattctaattaaatgcttccaatttaaatgccgtacatagagtctattttctctagtattaaattctttatacaacgtttattgtctgttctttttcttttcctacaaccaccatttttgcttgccttctacatgggaggaactatgaaaggctgtgaagacacaaaaccaaataagacctagttcctaacttcaaggtgcttacagtcaaagatgggatagtttccatgagagctcctctggaaggagagacagatgttgagtcaataattcctgtgctgcattgaagggtgggtaggaatgcttcttccctcacaggaaacagcaaaaggaagctgtgaactacatttttggttgcaagcttggaggcagaggatactctgcgtattgtttttgtattggaaagatcaaagcagggaataacagaaaacaggccacaaaagaactcacgtgtcatgctacagacgtaccaatctacctgccacttaccgagtgacagccagcatcttctgttggtcaagggtaaaatataatggtttgtggaaccaaaatgcctggctttcagaacttgttctcacacttctcttatatgtgacctcctgttctactcctcaattttctatctgtaaagggaagtgatgtgaaagagcctacctcatgaagctgttgtgaaggctaaatatgtcaatgtttgcaaagctaagaaggctgtggccacattgtaaggacttagtacaagtcagctatcatttttatattactacattggtcagttaattcttcctacaattttattaggtgagtgttattgcctactttacagaagaggaactcatattcagagactttacctgataaagctaatattacatgggaagtaaacggtaccacctaacaaagagctagtagagactgtctttttctgcagtaaggaaataacgtctcaaagagtattacctctgtaactgtttggattagggaatcattgaccctagttacgtaaaaaactccaaatgaagacaaggaaagtaactagcacattgcagagatttttattttcagttaatgtttggaaactcacatctcacagcccaaaatgtccatctaatttatcagcgagcattagagctgattggatgccttgtcatgcaaatatgaacaaggaatctcatcacagttgaagagcttggaatgtatgagcttaatgcatgtctactcagtctgtacatatgaaacatttagtcccttgcttggtatagagcgtgctctcacatgcagccttgtgatcacaatctcgatgcctgtaggagccaggcatgagggcgctaagtgaagcagctggcctaattctatgtaggtttcttaaatttatttttggggtacagtatcttcttctttgaatttatcttgatgcacgtaccccctgtgtttagctttaaattttccacttctgacgtaggcatggatataaaaaatgcttcacctacttcttaattacatactaataaataaaataacacaaactcgatgatagcaacctccagtggcagcaaaatggtagagaacagggcaagtaatgatgaaacagatactatgtgtccaatattgtcagttttcctaacttttacccaaagccagaggagtgaattttttgttttatcttattttcctttgtgtgaataagtattcaaataaaaaacacaaaacaggctgggttcagtggcccatgcctgtcatgtcagcactttgggatgtcaaggcaggagaatcacttgaggccaagattttgagaccagcctgggcaacatagtgagactccatctctacaaaatataaaaatgttagccgggcattgtggtgcgtgtctatagtcctagatgcttgcgaagctgaggcgggaggatcccttgagtccaggagtttgaggctgcagtgagtcctgatcatttctctgcacactagcctgagcaacagagcaagagcctgtcaaagaaaagcaaacaaacaagcaaaaaaacaacaatgaaaaaaaacaccacacacacccaaaacaagaacatcaagacaaaacattatatagatcaagggtatctgaacgagaaaaaacaacaggttgtttgatctcccagttagccttcttctgtttaggtaaggagaataccagcagagttttcagcaggaaagagaaatggttaggtatgcacgctagatacatcattctagcagatccatttgtctacctgttttatcactctagaggtggtactgaaactatggaagaagatatttctagaaaccacagatatagtggaacaaacaaggaggctatggcttaactctgggtaaagccaataataggagacaagcgtccatgcaaaaaacaataggaatgatcagagaggaaaagtaaatttaagtaatttaattgcttaacacacttcagaaggacccagtaagataaactttgaaaaatgccattttgttttggcaccttgaatttactcagaaatggatatgagaacttttggtagagtgaaagaattataatggctgatgtatgctattcttttgagaacttagattagaaagaaaccagtgatgaaaatcaatgcttagacagtgaattaagtaccaggaaagggtttatttttacaaaagggacttaaaagtgtttattattagagttatgtctctaatgtttacccaaaaggtggaaataaattgccattttttagcaatgaccaaaatccaggtactgatgctccaagtgttactagattatcacattaattctcacaaccatgttgaaagatagcttaacattctgttttagatgtagaaaacttaatttcaaagacgttaaatatctttcaggaagttccatgaagctttttaattttaatttttaaagtgacataaaatgtatgtatttatcatctacaacatgtttgaagtctatataaattacaggaagttacatgactttataatcagtattttttcttttgtttgccatccactcaatagtggttctagaaaaaatgtaagtgaatttagaaggatatctaatatataattatgaacagaagacaactcgtctcttttttcatcgcacactgccagaacaatatattttacttttaaactttagtattaaaactgtagtacgtgttttatttccttcctgcatatcatagttctatgtttgtttggaaattaaatcattaaaaagtttttctcactttccatccagataaacaaaaaaaagaatggttaatactgatacttaataataatttatattttgttatcaataatgaattatattataacatatatagcttcacattttgtcaggattaaattactttcatttcatttacttgcaatgtgtttgcattaattgaaaaacgtgggctccctcttgtgacaacatcaatgattctatatttcttttggagccacactaagtcacctgtctatgttctttaatttttcacaagtaaagttatatataattttatataataatgtaatagtattctttttttgataattcattctacttttttaaaaggaggccaatatttgataatatttgattctgattattgtttaaagatttatataatatttaaaaatattgattttcaaatttatattgaaaatatcaaggaaaacaggaaatgacaaatttagatttccttgttttatattttatatgcgatattagctgttttggttggcattccaagatatgcacataatttactttatattctacgtgttccctgtgtttgatatgtgtgcttatatttctcaaaatgcatggtgctcctctctgtttttctctgcaaactattcatgtgtattatttccacatgcctcaaggaagtagcatacatattgaactacccataatgggaatacccataatgagatcaaagaaagaaaaaaaatcatagttcttttttaaaaatgaaagcattatgtgctgtttataaatgtgattgtgtttgtgtgcttgaaagagtatagtgggtgcaaaaaaaaggaaaaatacagaatcgttatattcatggatctagctctggaagggctttttagggttatttcaatagtacgctgttaattaagagacctggatttaatctttgctgtctcatggaccatctgtatgggattgggcaagtcatgtttcttcctggtatgtcaattttatcatctgtttaataagataattgcattaaatcaacttattctctgcatgaacacatctgtaggaaataacatattttcctggctcagttgagtattgattattaagaatatgtctgtggggtgatggaatagggactttggtcgtggcaggctgtgaatataaagttgtcaagagagagggctgtccaaggtgaatatgaaatttcaggagctgagggggtgccatgcagggggcattcccattccccacttattaattataaataagcttgattctcagttctgttatccaagattctgtaaggccaaaagcattttggcaatgccatactgataggtaatatgagaaccaaaactgcaataaaaattgttaatattttttatttctataattcacacgctaccgagcattttgccagagtcaaaaaatataggctgcaaattgcgcactaatttcaaaagcttaaaatgcagttcaggagttcccctttccaccccaggtcccatcagtccacatttttttgtcacaggtctgctttagttcattatattacttgtctgattccaggagacatctgagtttgtggccctaattaacatatccgggactgttttttatgacctatgtaactgttgttggatttggttctgaggacttctgtgccacctgctccaataagactgagacacagactcttctagggagcagctgtcactttcttcacctactcaggaacacattccggttctgaatcttcgtgtctggatcccttctttcctttctttcatattcctgcattcctctctgttttgggtgatacctaaatgcgtggcctgcttggtcttggagctcacttttgtttcagcatgccatgtctcaggtcacacacaggcccacagtgtgtggcccacagcccagtctctccctttaacctctaccttatcctaggcctgatttgtttgagagagtaaatcagtctcaggctaggaatgaacaacagcaatgggtggctgtcctctcatggttaacacacttccatccattcattccttcatttacatcaaaaatatttattgaatgactacggtgtattcattacattctcgttgcttcaagaaatttgtgattgaatgaggacactttgtgggaagctcaggacagagaactggttctgattgctcaggcagatgtgacaaagtaacgtggtactttatttgggtatattagtgtgaatagtcagagctgaacttgcagttatgtgtttgttcattaaagaaaatctatggttcaccttctacatgaaaactgttttaagattctagtgagaaagactgacatggaggaagtgaacgcattataatgtataatattacaggggctaggggaagaaaatgtaaggttttgtgtattagcaacagagagagcgagagtgaggagagagagagagagcactgcctggtaatctttgagagaaagattttgtttactagatcatttgtcataacatatagttaaatttatacatgagtgaccagggaataatgtcagttttctgttaaattactggtaagggactccaaaagggaaggagtggcctctcatattatctttattagcaaccaccctccagcccacccttccacacatacctagtgtcatatcctaagtgttatgtatgtatgtatggcttgtgtttgtgtggaggtgtacaagcatgaatgagtctatgcacaaatacaagccatataacgttgtgcctgtggtgggcagagagtttaagcatgctccaattttagttgttgagacgtttgaaattatgtgcaactcatggacaatttcaatttgataactcgttaaaaataatgttagtttttaaaaagatacctattctcttgcctcaattgcatttctgcccccgcccccatatagtgcaccacttatgaagagaggtgatgaaaaaccttcatacaggattattcacttgatagaattgttgtcatttaacaaagcactgctacacgctttttcttcagtaagtaactaacttcaaggagtattgcctctattaactctctgaattgtgggatccttgactctagttaggtaaaaactgcaaaatgaagacaaggagaacaagtagctgtcttttttgactcatagagattcatacattttgtttttaggacctcacctcttatagcgtaaaaatcttgggatatatgagctttgagtatgtccattccctctatggattaaaaaccctgagtgccctgtttggtatagagtaggtgttctggtcatgctaggttcttctcctttctttttactttgcattcttcaaaaacaaaacaaagcaaaaaaccgtcagaatctgcagcctgattataggtaacttttatcctcaggtgtcatgttaatatgcgaatatccagcaagcatgtggtccaatcccattcagataatggaatgtgagtattaagcttgtagcacagggctttgttagctgttagtttttttgttttttttttttttttgctggtgtgctaattgcaaagtgatctcctctcaggacattaaaaaataagtccttaaaaaacataagtttgggtcacctaaaatctgtgtgtatttacatttcttttatttttttcttttagttaattgctattttaatacagggcagagcaggactgcaggaggtgaggtccccttagcaaatggcaacagtggggagctttgaagcacttagcacccactacagcaggaagagcagggatgtcatgttccttgattattcctggaaaagaaaaagcacaggatcctccttgagtgctgcttgcaaagctgtctcttaaaacccctttcatttatggttgtattgtgccttccaccttaagtgtccctgtatgttgtttgactaaatctaggggctgaaaaagggattttctccttttaactgtttagtgccttcatatagtggttcccaatcctggctccctggcttagcttttggaagctttgctccccctgagactttctaaatcagaatttctaaacttcagcctcttgaagctaaggttcagagccaatgcattttcatagaatggatgtttagtaaatctcaactgagaaacatggactgaattaaatttttatattttacctgaaatatactctctaccttgattgatttgttttataaattgtattcctctcatctaatcttttgaatttgttcataatatgagaaggcactaagatgaggtgacatatggtagtatgttgtatacatagagtttctctcacttgcatcattattgcatttaccacattttttgcaaatatttaaatcttcagtagactaagaaatctataattcagggaccatattgtcctcatttcatgtcccaggacacaggctcatgtctgaacgcatagaaggcgttcagaaaaaaaaatgaacaaatgagttatagcattgttgtagatttgtgtctaaaatatatatgaaaagttctataattattttaatttttacatataattaaaatttatagatattgctccagaaactactactaaaatgatacagcttatgttattggatcagaattctataaaactaataaaggaaatataatttggttttgatgcagtttacatatatattagggaatgattactaaaaagatgctttttagtaatctgggagaactgggaaacttttgacaggggaaatcaaaaatttgcagtccagtgaagaattaaactactgggagtaataatatgggctgatgcactcaatatagcagtaatgccctctgagaaggataggaaataattcagttcctccaggctgcatggaagctaaatacagtatgacaagaaatagtagcagtactcattatgtctgattgctaattacctctttgaatgattcagttatgcctgctactagataattagtttagtaatttatggctgcggcacaaactagtattttaatttttgcagcaccattttcacaatacctacagttcagataatacctttttaattcaatgttaaattgcttttttgaagacctataaaagagcaaatattcttgcatttttttctacttgtatttcatgaaaaagttaggcactttatggaattttatttaactttaaactccagaaaaataacatcttcttaagtcatgtcttattatggttaattttgccaattttgtgggcaaaggggtgaaattttcaaaaagattccatcaaattactcaatataacagttgccaaatttcatttttcaaaaagacattaaaaaattgataataaatcttttctttttacacatttctacttcatacatggggttctgcttatgtctgggtgtctgttcccaatgctcaggagctgcaaactgagtacagcttttctgcattcccaaccaatttggtgtggtccacaggcaagtcaaaagctatcagattaagtaagaatatttcaagtaagcatttccaatttctattcgggtaaataagattaactctagccaaagagaatataattgagtctctatggcttaaagtttggccttgggtcagtatcctcttgaattcacttttttgttctctaatattccaactatatttctgggttttattggtgaaataaatatgtaattatctaaaattattttgtcatctttcataaacattcatttttagttccgtatccccactactctagtgcagttagtgatataaaaataaatcagagcaagagagagaaagacggaaactgatatagtatgctccccaattctgatgactgtaatatattttcaggtcacagcccaaagacaacattgatcaattaaattcacatgacaatttcaacttactcatatatttattttcatttatatacagaatgtacatatttgccaaattgttgagtgatattgtgagttaggaattgattttaaaatatcccttgcctaggtgttggattatcaggcttgaattcttagtagctgatggaaaagttgccactttaagatcaatataattaagactagataattttcacaatgaaagagagcattgaaatgcttagaataacaaataaaattttgcattaaatactgggttttgccatccctaacagatcaaaatgaatgctttaaaattaataaggggcactgctaaacacattgccttatggctaagagtttatacctagcatcttaaaattaagaatatttggcattacttattcccatttgctttctacttggtgctttgtttttctctataactcaattacaaaatgctcatggttttatttgctatgttgttctcatactcgatatttaccagtactggatcaatgttctaaagggcagccctgatatttcagtgaacatcaggctgatgtttattacagaccaaatctgtgccctttattgccaacagtcttactggaaatatgtgttccttgacccatttaataaatggttacccacagatagggcagtgtgactctttttcttccatacatgctttttaacaaaagtttcttacccgtaaggcagtctgtctaaccatcaaaacatcatattgacctttccaactttgctcagggtgacagcttggtttgttgttgatactactttttttttttttcccctaagttgctaactagagctctcacaaagttatgtgctgtcagagtttgaggcaagtcaattgctttagattcataattcattctttttttgcttgttttaatactatttatattctaaaataaaatgtagcccttataaagtgtataaaagtatcagtattaaagtcaaaacttataggtgattacctcattgccaattatgaaagtccaataatatattttctttttgtctatattaggaaacttttttggttctcatctcactagtaaaaaataaagtaagcactggttatcaatataagggtgacacatttataaatgaattagcaaccaacaggtagtactctttagaaggaagatgctataatgcctgtgtttcccttacaagtctcagagagctgaaattttttaaagagttaaggaaatgttgccaaagctttcgtaattgcattgttcagtgaacattgttgtatttagcatagaactgtttatgtatttttgtacatttctttcattaccttcttttctaaatataaaacaggatagatcactggataaaaatatccaaaagaaagtcaaagcctttatttttgaatttgtgtatatatgtatatttatgattaagatgtttgtgggcatttctccttaaagggaaattcagccaatttcctgattttatattcttgatataaaggggctgtgtttacctcgtttgaatacactgcttaaaatagatgcagtacagtatttcctactgcgtctcatcagagcttttaaagaattaattagactatcatagaatttgatactttggagtgctaagaattctcttcataatttcttgatatgtgatattatgttatttcgtttgagcaagtagcaattttaaacacatgtgtatatgtccatacaaatataatagctctttggagtttaaacaaatgcatatatataaacatatacatatatacacacatatataattagagctcttggctatttagaagcttaatagcacatataattctatctcaagaggtgcttaacaatttcctaaactggagagccttcaatatgtctacttcagacatgatatctatgaaggtaataggatacagaaagagaaaatatgtatataatgataggagagaaagcagtattttatcatgcaattgatttatttgtccagttaagcttgttgagctacaaatcaagaacacattttagtataaacaagaccaaaccagagttcaggtccacagagtttaatatctaacgagagagagaaataaacacatataatttacaaacaactcaaaacaagagattgcaatcacagaaatatattcaaagtgccaaggcaactcagagaaaggaaaggacaattaatttaatcttgaacaattgtcttagactgatgctgatattgtctgaattcagggacacagtgtcaatgacattgaacatctcttattcagaaatgaattaaataagctgactagtttcattaatactatctcaaacaacaggttttgttggcttaaaaaataaaatcttggatgctctgagagcatgtaggtagaagcagagaaagaatattttaaagccttaagtggaagcaaaatgttgcctaccattttgcaaaattgggtactattatttttatttgtttatttataccaaatccagatgtaggctaattcaatctcaaacatgaaaggtgggcagattttatcattaaggtataaagtcatgctgaagattacatataataaatggacttcatgtacttccagaattccaatgtcagaagtaatgcatctttggtatcaagtcagtctggacacttctaaaaacaaaatgaatatactgtgatgtggggtgtgtgccacgtgggcatcagcaaggaagagatagattatctttcaggtagggcagagagcatggatggaaagctagctagagcagagtcagagtcatattttagagatgtaagatgggggaagtggtgactagcatcaggtagaaaaatacttagatttctagaagctctgtgtttgtttgaggaggtagggcaaaccttttttaaaaatctggtatcaggtcaactcttcccagaaaatagcacatacatgcacactgctatacataacttcataggcttcatagactacttgcgatctttaaggatcaatgagtttaagtggaggaagggataatggaagtagagtatttaccttcatttataaagagcctcacattttaaatcaactcgatttgtgttcgaggtggggtccttgttccaaatggatactacagttaaaactacgagctaggggccacatgcactggctgaggctttgtggccacctctttggtgctctccttcacttggcattcgccttcgcatctagttaaaaaacatttcatacatctactctttcaggaagctctcttttaacattcaatgttaggtactttctcatcccaaaagtctctcccacaatagagtcacaacttctatggaaacaaacaatgtctcactcatttctgaatccctgttcccaacacagtgcaaggcatgtgggaggaggtactcaggaaatctttattttatgaatgaataaaagctaacaattgtgtatagcaggttttgctatgtactagaaattagaagtagagaatactcttcacactgcagaaagactatatcaatgcgtaaaagattcacataatctgaagcaagttattttatatggaatgaattggggtaactatacatagtataatataaaattctttgccatgcaaaggggaataaaaatgagccaggcgctgcacagaatttgggaacattgattggggaacagttctgaagtagaggcctattgtgtaagtaaatctctggctgagttcatcggtctcctttgattgttcagctaatgtcacttcaaaacagactatgctttcttcatgttaacccttttttaaaaaaattgaaactgttcagggcttcaagactagataaggtataccttatgtctggtataaaagataaggcattcactgtggaatacaaaaccagaaaagtggcattatttttttccaaaaggaaaaatgagctcattatgagagaagaagaaacctttcatcagagcaaagaaaaataggttcaaatagaataaatctgtgatttagccattttccaaaagtactgagtttttgctgaaagaattatcccaaattgctcagattttggtgtttgtagagaaaatatagtttctataggattctgttttcttcatatcaaagaattgagccattcagggtttaaatattgaaaaatgaatttaacctagacctaatagaagacaaagtcaatcacaaacatccataataatcaaatgggcaaagctctcttacatgtatttattttcttaaacattaacaaatcaattcaattattcagtctcttgctttcaggatctctagattaactgggctgaaataatccttaagtccatttctatatacatttctgtatctgttttatcagaattcttggtatcttgggaatttatttttcctgaaaacaatttacatcagaacttaaacatgggcagttcatctagtctgattgcctagaatcttcctggtttcatctcagttccactctatcttcagccatgctatttcctctgcttagtaccccaacctcaacctcaaatctatctgataagtagcccatattgtttctttagaactcaactcaggcataccctctctcttctttcagtctattttagatgtatttttctctctgttccgagggtaaaatgtacacaattataaaatgtagtgaggaagagagaccaatggggcagagagacaagcatgtagctctctgaaacagactgggtgaggtgttgctcactggtgcctagcacagatgttggaccattgcaggatcccccaaaagtttttgaatacattaaaaaatgaccttttaagctgcaatcatatgccttttctaagcactgcacattaattaactcgtttaacacaacactcatccgaatttggtatcactgttataccaacaggaagccaagaggatactaaggttcaccaatggtgtatgacttttctgtagtcacacaactagtaagtggcacaaatgcaatactactcctgggcatccagcccaaaccaaatgttcttctttattatgctccatattctgacctgattatattattgaaggtactggataattgagcttgcttctaaagaaaaaaaaaggtgaatgaatgattcattgtctgtcatgaattccctaagtatttattaacctctctctagtcattaattcaacagataatcattgcgttcctactatggcacaggcactgggcatctacaaaagaataagatacattctgaatacaagtgactgagattcagaaggggaaagcatattatatattgtgttttgttcacattgcatcataggaagtttcagcctacattacatcatcttagaataagtacaattacatcagccagaaaatttttaaattaatattctttatcatttaggcatttaactctgacaaagatactatagtacattttgtagtgaattgatgtaattgccctccttggatactcaattttaggagtcgctttgagcatccacacatttctgcagtatacagtttatgaaacttaccagaaaataaaaggaccaatctaaaataaagaatctctattgtatttttctactgacaatgcaaatgcttatcttaaaacatctaattttttcccccttttcacaggcaagcacaactgtaacacttccagaatctcagttccttgccagttgtcattctgaagcataaatggaatgcagggtttggaagttgtatttgctctgcattaacaaaagaagtaaaagctgtttttccctcacccctaaatgatgtaccataactcatagaatagacaagtagtattacaagatatcattttcatagacactcttctaaacctagctctggataatataaataatagagttcactttaaaatttttaaatactttttgatggcagagtgtctttcatttttgttttcattgataacgttctctatccttaaattaactttaatcatgtaggccatgttgccttttaccaaatgtctttagcagttctaatgatatacaaagtgttgtttttgcagtattttgaaaaagggacatattaatgtttcacctttagaaagtttttttcacaagaattgaatcactttctgattgttctgtatgacatcattgtagatgtataacactttttggcttatttaagtttattttaagcattctctaatatcttacgccttgtcttaacctcagtattaatcctgttgattacataatttgtattctttgaagcctatttcattatttgcacgtctttctcctttctactcatcttgagctgatgaacttgaattacccttttgctctaaaccttaagtcagaccaaattagaataactcctcctttttttctataattatttttcctttcttgtattattactccttaccacattgtattgaacttgtttaggtaattatctgtcttctaaattatgctgtgtcattgacaagatatcaaactgtatcttatttacagaggatattttatgcttttagccccagtgccaagcacagcttctgacatagagcacatcctcaagaagcgttttttaaattgttgaatataaatagcctaaaagaccattggcatctgatcaaaattaatttttacagccaaataaattaacatcatgttgacctcaacttaattctttcatttgtcaggaaataaaatttgaattgtttgaaataatcaacttcatctgtactttgctctaatagttccttgcatgtgacaattgatggtttgctatttaaataatattacaaatgtcaaagatgataaatgtgtagtcctccatcttcataccctggctgagtgtagatattgtaaaaatgtccatttaagtaaaacaatgagggcataaaagtacaattcggtatttccaaccatgactcaaaattaaatcttttcaacacatgttttaaagaacacatagggttctatactgtatctagaatttttcttatattaattgttgattatatcaagtcttgagtcttgtaacagaaattcattttatttcaaatttggactcacatgatactgtgatatgctttcccctaattacagagctcctccattatctttcctttctttcttcttgaggaaaaaattcactgaaacatgttttaaggacaaaagatttcaaacttataaaaatatttcagtcttataaaaagaaaaggtaaatcaaagttggaacctaatggtcttcataatgccactaaaagttcatagctgataggaagaatgatctatcacataaaaagtagtttagttaacctaacaaaacaaaaataggttatattttgcttgtatggtattaaaatataaaattataaacattagtattgataaaggttatttctaaagccatcttatattttaagtagatgattttcagcagatcaccttctgtcttagatgaagtatgtatgtacttttttatttaaatgaaatgagataccatgagaatgaagaatgctctagggaataaaaatcattatgaattattaattttgattatattttaaaattaaagcatttgttactaaaaaatcttgaaacataatgtgacaagaagtaaaaataattaagtcaaacaaatgcaagctaatttataaatattttataacatttattgagtttctagattgtatatgaaactaatggaacagatgtcaacctaacagagaattgtatgtagtatgataaggcaatgattaaagtctacaaaagggattattaaatcatctaaaagggacagttaaccaagactgagaggtctaggaaaactttttagaaaatgttgcatctgagttgaaacttgaagaactaggaggcataacaaggcgaataggaaataaaaggaaatacatttcaaagccatgattagaagattaggacaaacatggtcaatcagggaattgtgtgggagtgtaaactgcaaataaaagtaaacaaacataaaatggggaggcaactgggtttaaatcattaaaggtgttgtaggtcatgttgaggagtttatcatgacagcaatggggagtcattgaaagaggttaaacagaagtaccaacaccagtatatgtcctttgcaatggaggaatggaggcatgggtggtaaagatgtttctaactgtgggaaatgggagccaagggagaggacagtggattgagagagtttctgttttgatggcttctattttctctataaataaaattgctgaaatcatctccagtaagtgagagagaggatagtggagtagaatgtttatggaatgtggtgaagacataaaatatcatctgttgggaaatggcactgagaactcatctgcgaagctataaggaatgattgctgggtgtgttgaacttcctcttcagttttttaggacactgcttcacatatttcttctgcttctttggaagttcataggaaaggacagaaaacacaaattcttaaactatagaaatctagataggttgatacgaaatttagattttactttatataaaaaacaggaacaaggtttaaagatgttgaagtgtagtcgaagcaatgagatgtgagattttggctaaatacagaagggagtgaaatgtatttgcaagtatacaaatatacctggaggttatacacacaggtatgaaaatcttgaaaggataaaatggtattttgaaagggtagaatataggattttaaaatgtgcaataactgaggagggtttaaataaattatggaagatctatatttgtggaagtctaaatgggtagaatgcttatggaagcaatttaaccttgtccatcaacttcaagtgcaaatatcattcaacccaaaaattccactcctacaaatttcacctccaggtatatttgtatacttgcaaagtgaaggctgtacagggtattttgttgctgcattgttcgtaagagtaaaatgcccatcatagagaattgcttaggcttattatggtgcatccataaaaatggcattatgaagctgtaaaaagaaatgcaaaaactctttatggatgtaaaatgttcttcaagatacaaggttaattaaaaaagaaaaacatcaaggttcagaacagtgtggtataatgcaatctaaaaaagggggaaaagcctatatatgtatttgcatacctgtgtataagatactttcaaataaatgtatatgaaaataatataactagttgctgatgagaagttggagggtcggggaacaaaagtggaaaaagaactttcgtggtcatttcattgtatattttttcatacagtataaattttgaattagaatgtattactatggggtaatttttaaaaatcaaactatagatataacaaatataagcatataagcttttgtaaatcttagtagcttggaaatatattcaaaataatgagcttagggcagggaagaaaaaaattacacaagaatatacctataacactgacataatgcaggcatagtaaaatgataagagagtacacccaaaatatcaacagtgtttgctaaaggtggtaggattggattgcaagcaatttttattctttgcattttgaatatatcttagtgcatatgcattatttacatttgagcaagttggcccaatatgctatgaatgttattactaaaggagaaaaatttctaaaagattactctgagataattcctgagactccattcttttaaatgtggaaaccctgtttttgatagtttgcaatgaaatataatacagagaaatgtagaatcttctatgataccttccattttaatcaaagatcaaaatgtgacagatgtgcctgctaagaacttttatctgttatcataaataaaatgcattcactcatctaaattaagagaatattgcaagaatgaggctacaagacaaatctaatgaagggtaatatagaatgtcagaaggcccacggaattcacaagtaaaatgaataaccattcacttttatgttttcagcataattgacaataaaggaataacttccattaaacattcagataaacaaccatattctctaagtacagtgtctgcaaaatcttgttttctggtacaagctaggaattttagtacagttgtaaaatcttctgaaacatgtctgttttttcagttaataattcacaagtctattaaatgtatggtcatgagagaggtcaaaaaagaatgttatacttcttcatggcaaaaaataattatttaaaagttgatgtttaatgtatttactgtaattgggattcgattttttgaaatagccttcaattgaatggtagaaatgtggaaacatctaagcagtaagattacatataagtcttcatcccccttcctcatttctccccctatcattaacatcttgcatttagagtggtacatttgttgcaattgatgagccagtatggatatgctattattaccaaaagtccataatttacattaggattcactctttatgttatactttctgtgagttttacaaatcataatgacatgtatctaccattacagtatcatacaaaatagttgcccagattgcagcagtgccattttgtatttctaccagcaatgaatgagagctcctgtagtcatacttccgtgccaccttttggtgtaatcagttttttttttatttttatttttttttattttagccattctaaggtgtgtagtgatatcttgctgttgttttaatttccaatcgcctaatgatgtatgttcattgcttatttgtcatctgtttatcttctttgatgagatgttcttcagatattttgtccatgttttaattagattgttatcatattgttgcattttaaaggttctcaatatgttttggacaccagtctcttttcggatatgtcttttgcaaatgttttcgtttcttcctaatctgacttgttccgtcctctgaattgtatttcaaagagcagtttttactctctttgtaaaaaaaaaaaaggcagtttgaccttgccaaacctaaggtcacctagattttctactaggttatcttataagagttttatacttttgcatcttatatgcaagtctataatcacttttgagttactttttgtgaaaggaataaagtatgtatctagattcatttttttttttttttgcatgtggatatccagttgttctggcatcatttgttgtaaaaggcttcattttgtaaaacttatttttcttcatttatttactgagtttctagtcccttcataaaatatatggcttcaagctcatttttctctctctactctgtttcctccaaactatcccacacttttaaaaggaatcttccatatttttctagccacttttataatggggaatgtcttccataacatcctgaagttcatcatcaaattcacactaagggataggtgatgattttataaagcaacccacctttgttttgtataacctgagttattcattcattcattcattcaacatatattaagcacccatttttaaacagatattagtccaagaaattattatactgaagctaaaagtactatatcctggttcatccttttgagaaatatacaaatatttgtactcttaaatgtcattgactttcatatttgttagagtgtctttcactctttctcatagtttagcagttttctgttcttccaaacattcctaatgtgacattgatatacttgtatctgggtgtaatttcacttgtctatgctcctctcatgacactgtttactcagttacagacaattgctctagaggtcttccattaagtgtagtgtaaaatgggtctattactttctgtgacatggacaacatcctgtattaagctttaaatcactggtatttttgctgccaaaatagcatactgcactatcatattaaattcattataaaattaacatttgcctgttggtcatattcaatatttttcaagtgtggaaaatctcaatatgaggtgccttgagggaatgtagtagtgggggactaattttaattaattttaatttaattgtgtattataccaaggtatccaaagaggcaatgtactataatagaaaaatgctgcatttggcattgtgaaattcagatttagcgtgtgtctgatacatattagctggttgtgctcagtaagttatttaacttctttaagcttatgtttattcctctgtaaaataatgatgataacaatgcttgccttttctactttctaatgtgttttgagagattaacattgaaatatatatgaaaataattctaactaaggtttactgggaaataatttacataccttaaaaaatcaccctttttagtgtaccattctattgattttaacagatgcacatagtcatgtacccacaatcatggtgtagaacaatgccatcaccccatatatttccacttgtctctttgttttttatgcctggcaaccactggtctgctttgtatccctatagtttcgccttttctagaatgtcatatcaatggaatcattctgggtgtggcttccttcacttgtcataattctctgatattcttccatgctgttgcatttatcagtagtgagttccttttttattaatatatttttaaagtttttaattttattgaagtccagatcattatttaaaaacattaaaacaagttttttttttgtttttttttttattatactttaagttttagggtacatgtgcacattgtgcaggttagttacatatgtatacatgtgccatgctggtgcgctgcatccactaactcgtcatctagcattaggtatatctcccaatgctatccctcccccgtacccctaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtgaaatggtatttccagttctagatccctaaggaatcgctacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtccattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaatagaataccctttatttccttctcctgcctaattgccctggccagaacttccaacagtatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctgtattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattagaatagtttcagaaggaatggtaccagttcctccttgtacctctggtagaattcggctgtgaatccatctggtcctggactcttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattccctgatggtagtttgtatttctgtgggatcggtggtgatatcccctttatcattttttattgcatctgtttgattcttctctctttttttctttgttagtcttgctagcggtctatcaattttgttgatcctttcaaaaaaccagctcctggattcattaattttttgaagggttttttgtgtcactatttccttcagttctgctctgattttagttatttcttgccttctgctagcttttgagtgtgtttgctcttgcttttctaattcttttaattgtgatgttagggtgtcagttttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcagattgttcagtttccatgtagttgagcagctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgctgagctgagttcaattcctgggtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgataggtcttgactctttatccaatttgccagtctgtgtcttttaattggagaatttagtgcatttacatttaaagttaatattgttatgtgtgaatttgatcctgtcattatgattatagctggtgattttgctcgttagttgatgcagtttcttcctagtctcgatggtctttacattttggcatgattttgcagcggctggtacccgttgttcctttccatgtttagtgcttctttcaggagctcttgtaaggcaggcctggtggtgacaaaatctctcagcatttgcttgtctgtaaagtattttatttctccttcacttatgaagcttagtttggctggatatgaaattctgggttcaaaattcttttctttaagaatgttgaacattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagactggggaagttctcctggataatatcctgcagagtgttttccaacttggttccattctccccatcactttcaggtacaccaatcagacgtagatttggtcttttcacatagtcccgtatttcctggaggctttgctcatttctttttattcttttttctctagacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaattttttttcaaagttttcaacttctttgccttcggtttgaatgtccttccgtagctcagagtaatttgatcgtctgaagccttcttctctcagctcgtcagtcattctccatccagttttgttccattgctggtgaggaactgtgttcctttggaggaggagaggctctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggtgtcaggggacagggacccacttgaggaggcagtctgcccgtcctgagatctccagctgcgtcctgggagaaccactgctctcttcaaagctgtcagacagggacatttaagtctgcagaggttactgctgtctttttgtttgtgccctgcccccagaggtggagcctacagaggaaagcaggcctccttgagctgtggtgggctccacccagttcgagcttcccagctgctttgtttacctaagcaagcctgggcaatggcaggcgcccctcccccagcctagctgcccccttgcagtttgatctcagactgctgtgctagcaatcagcgagactccgtgggcataggaccctccgagccaggtgcgggatataatctcgtggtgcgctgttttttaagcccgtcggaaaagcgcagtattcgggtgggagtgacccgattttccaggtgccgtctgtcagccctttctttgactcagacagggaactccctgaccccttgcgcttcccaagtgaggcaatgcctcgccctgcttcggctcgcgcacggtgcgcgcacccactgacctgcgcccactgtctggcacttcctagtgagatgcacccggtacctcagatggaaatgcagaaatcacccatcttctgcgtcgctcacgctgggagctgtagacaggagctgttcctattcggccatcttggctcctccctccaaaacaagcttttttataagttgtttttaaattacttgattaaagatgtacacatccacttgcatagaatatagaggcaataacattaagagaatgattattctcttaaggcctacactatcatttttggaaatatttttctatttatttcagatgaaaactgaattcccaagggcatgtttttcaaaaaatataactttgtaatgtttgtgatcatatagtttgaaatgaaattaaaaacaggaggtggttttcttgaaaagtgtggattgaaaggccaaggtgtgactgattgtatgggttttttttttttctgttgccaaaaaaagcctttttgagctgaacaagaaaggtataaaattaaagtaaatgcactcttcaaattttagtagcaacatgaaatcttgctggcaatttgatgttttactgacattgtgtcctgccagcctattgtgaggtacatcagatgtgaatgctgcttattttccccagtgacttctaaatggtcttgtggagtagctcttatgatatgccagcagtgtgtcagcagaataccagtttgtgttccagagcctgcctctttaaatctgaaagttatcccatgtccttttcttgtttctgccaaattctctactcatagtatataattatatgttagagggatgattacacaccaatgaattacaatcaaacttggcttgttagtatataaagctttggttgttaatcacaatcatttaaataggagctcaccctccctgaaatgcagatgtcatgttactatgggttagccttccccaaattggaacctgttatatattagaaagaacactttggagtcatatgttcatcattgcctcttttctgtaacattgagcactgcctcttggctctgagttactttgtgaaactggaatcaatataagagtttatcgaaagaatgacttctcctacaaagtaagtgttgattttctaatttcttggacagagaaagtcaaatcacaccatgtctggtagaaaatatattgaactaatatattgcaaagttattgctattaagagaaatgcaggtttttaaaattagctctttgtttaggctttttcaaaaaagatagaaaacaacaacaacaaccagccagggacagtgtctcacacctgtaatcccagtgctttgagatgccaaagtgggaggatcgcttgaggccaggagttctagaccagcctggacaacatagcaagaccacatctgtacacaaattaaaaaaaaaaaaaaaaacttagctgagtgtggtgttgtacacatgtagtcctagctactctgggggctgaggtgagaagatggcttgagcccaggagtttgacagcctgggtgacagagaaagactctgtctccaaaataacaataacagcaacaacaagaagactggtttctcagtctcacacaggacacacagaattgtataacagtcaacattgtatgaaaataaacaaataagcattatctaatgcaaacttcattagatagatgcagcataggcctcatttatcataacactgtgaccttgacaaatttcttaaacattgggtatgtcatgttctgcatctgtaaaatggcaatactaataaaacatttcccaatggattttgtgagcaggaaataagttaatattgctaaagttcttaggacacttacttggtacataaaaaataccatgaagtgtttgttatataaataaacttggtaatcctaacattatattgaattacaatactttggacaatacttacacatagaaattagaggctcagtgtttgtctagtaaacagaactgcaaaattctcagtaggaacactttcattactttattcataaaatagtatgaatagtactttatttttttatcgtttaatctaaacattctaattctttgttcaggatgggctaatttctcatctgctgcttatctactgaccattcaaataccatttgtaaaataatgcttttcattcctttatttgaccattcattcatttattcattattcagaacttcctgtatccctggctatgcaaatttgtgtgtataaggtatgcttcctcttatttcctcttttaagggagataggtatatgaatttttataatacaggacaaaaagaggatgttggaaaacagatggagagcaaaatccctagtgagttcaaaaggctgggactgttaattctctctgagagatggaggaagactctaaatagcgcctgaagaaatgataggatttggacacgcaaagagaaaattctagagaaaaagaactatgaaatctcagaggtcaagaaatgtaccttagtatctttgtgtttagagaaactagtccatttcactggaatacataaagtacagctgggggatatgagattgggaataaaatttagaccagatcatagggaactttgaatgcaagtgaaggtttttactttattcattggacagaaagggaccttccttgaatgtaaactcaagcctgaaaaaaaaagtagacaagttcagatccttgagtgaaataaatctggctactagttagagtttgaatgatgaagaaaaatgtttttgacttaacagtttttactttttcaaaatcttcccttcattctaacagctctgaaagtattattttcttcaggaaatggctctatgcggactgcctgctagcttactcccatgcagggatttattttcatggaataatctttgagactggattgcaaaactcttcttttagaagtcatcagaccaaaattcttaaccttgctgagcctcagctttagtactctgtcactcaaaagtggtgaaaaaattaggaagctttaaataaattccttgtagttctttacatttttgtgcatatctgttgggggaaatgggcagggctacccaggtttatttagaataatccaaatagtaatagtgtggtttatttttgaagctgactaaaatatttttaagaattaaactcttaatatataatacatgtgctgaacattcttaacgactctaatttaaattacatatgtaaaagtagaagaatattagagaaaaagttttacattcatcagataatttagttaggcaataatattagatttaaaaatattagtttttaaatttaatattgatttattagatttaatatttaatttaatattagatttaaaaacatcatcatgatcatctttaaagtgcttttaccaagagctaaacaaaaaaattgaaagtgaattcatgtaattagcaatatttgatatagaataatcaaatgccaattaaatttattacttttaagaagttatccttaaatggttttttgaatgtgaatgttataaagaataatatctttcactttatttaagctttttctttaaaaaaatagtccttatgtggcaaattagttttagaacaatatacagcattgtatgtatggaacatttttgggtatgttcattttgtgtacattttttcttttatcagtgtcctttgggttttcattggtaattagtagaaatattttcagttgagaaaatgtgatcactatgtcacttaatagtgttatttttaataaataaattattaatatgttctacactatatctgatctatcatgtgaaaccatattaggccaataaactcctcttatatattttggttattagtattaatattactatacatacaattatcacttttcattagaataaaatttttaaattctttgtctcaaaaataaaatggaatttggttcattatatgaaattcttgttcatattacttaaggtgacttgtaattcagagagttattgattctgatgcattaagtagcaaacccatgacattctctttattatgagctctgatatcaaataaaagatgggtttacttgctctttcaaaaattgatttattgccagtttcaccactgtagatactatctttaaaacaaaattaaacatgcgaaagaaatggaggtttagtaatgaaataaagtgttgactaatgattacttcaaagcagaaaggttaaatatgatatgagtaaaattttaacagtacatgctttccacttgattagtttcatacttgttcatgcaaaaggtcatattgtcatttaccaaaaatatggaaatctttcgagttgtttgtgtaagcaaggtttaaaaaagttactttaaataaaaagtagtaagaatactttagggaaaagtaaatttctaattatttttcctactacaattttatgttaattggttataaactatggggcaagtgcaagtttctgagaaaatttcatagtactagagtatatttcctagccctttagagcattgtatatgtggaataaattcctcgatggaacttcaagctctgattattacctaagagatttctttgcaattgtagtgtgtaataatctctcaagttttatcttggtgggattctgatggtgaaagttcagtctcatgacattgtaaagagacgtccctgtaaatgtacctgaatcaaatttttctgctaagaaacttggatatttcaaactatctgcatttatttagactaaattttgtgtggtgaatgtgaaacacactgtactctgatgtctatttcttcgaaaaaaggaaatagaaaaatcacaagtgtaactgcaattccccacccccacccccagccccaccccaccctttttggtttgtttgtttgtttgttgttttattatactttaagttctagggtacatgggcacaatgtgcaggtttgttacataggtatgcatgtgccatgttggtttgctgcacccattacttgtcatttacattaggtatttctcctaatgctatccctcccccagccccccacccagtgacaggccttggtgtgtgatgttccctgccctgtgtccaagtgttcgcattgttcaattcccacctatgagtgagaacatgtggtgtttggttttctgtccttgtgatagtttgctcagaatgatggtttccagcttcatccatgtccctgcaaaggaacagggtctcactttcattgcccaggctggaatgcagtggcaccatcttggctcactgcacctttgacttccagagctcaaataatccttccacctcccacctcagcctcctgtgtaactgggactataggtgcacatcaccatgcccagttaattttttgtaatttattggagacaggttttcaccacattgcccaggctgtttaaacaacttatttttagagacatttaaaaatatataaaacaagtgttttaggcagattagaaaactctaatataaaatttttgaaggcaaatacctttagcttaatcaagggctagaaagatagaaatatgtgtttagacatacaccaaagaaaagggtttataatttattttcttttatgagaattgtgaattatcagaaattgttagctggtagattaaacaattagtgtttacgaagaaagtgtttggtaaaagaaaaaaaaggcttttgaatcttgtggctaagaagttattgaaggtatggtctccagaatttgtttaaacctactatagttgctgttgtccctttactttggagtggatcaaatctgttgcattaagattgtcgtagtctaggctggcatagtctaggttgaatatatgatatataaaaatactatttcatcaaaggaattacaatccagaagtttttaaatttggcattaatgttgctaaatgatatgtggagaaatacaaatccaggttaggaggtcagaaggattatagtaataacaggcattcattcaataaatatttgttattactacatttcagggataaaatggtgaatgaaatggatacagtccttgaagtcctacaacttacagtctgagatagatgtggtacagaggggaacatttcataaggaaaattgccagtaaagaaataaggtagtagagaaggcttctagtggaagttgttaaccttaaacagggaagccagattctatgctaatttcaatgtgagatgaatctaattctatttcatatatccaattcattatatctatatcaagggaaagctagccttgaatgatttcttgccagtacttttatattccacagacagtacatctagtcaaaactcttttcaagcttccactcccatacacaatgctttgactcttatggaaaacctcttttgctttctataaaaagcaaagccatgcaaggtaaagtattttattcttaatcttctttttatcttatcaaattgctgctacttcagctcttactgttcttgccttaaggttaacagaaaggtttactttttaataatctcttaaaatgttgagccaatgtcttattcctactgatacctgaaggttcttgtctcatatttactctctcttctaaccatacatatcaatattagtatatttattccctcgttgccaaatttctcaaataatctgtttatacagacatccatggaatcagggcaaacattttttattatgctctcccaggcttctgatgtgttaatgatttaggggaaatgttggtcctatgcagtgatgcagcagatgcggaaaggagcacaacattaaggagaagttttaattcaattgtgaatattttcagtttgaagaagtccaggagctgactgcaataactacacttggggctcatctgaatatacattcatagcaaaacagactctgttatatcagatttttatgtggtaatgaagacatggttttggaagacgtggcagagaaataataatatggaataaaaggaacacaaagtagagctccttgatcctcacacagggcaaaaaacatggtgataaatttgaaatcatgctatgaggctttcttttctttggtgtcattcacttattgctatgtaaagtaccaatctgactcatactttattttctaggtaaaatttcaagtctttattctcattgccacatgttagctgtattcatcattttgacttaactagcagatagccctaattctttacaacttcttgcatccatgtcctatttttaactaaattggatcgggagttagggtatctcctttagcatctaacgctgttgctttttcatcataagcactgtgtgtgtgtatccatctatctattgatttacatatattttaatataatgtacatataaatatatatttatttattgatcatttatataatgctcattatttctgccattgcagaaagtgaatatgatagagaactggaggttatcattattgaatttatatatacattcaatatatatatcaaatgtatatatatcaaataaaaatgatacatgtatattaaataaaaatacgatatatatttttgcttacagatttattataaataaataaatatatacataaactcaataatgatgacctccagttccctctcatattcactttctacaatggcagaaataatgagtattatttgaaagttgaattttagtgaaaagaattaaagcgtcacagaaagtaatttttaccattttatcctgatccttagagcaaaggtaataacatttctagctttatttctcataaaatgagtggaagtgatatccttaacacccttatggagtaagaggaagatatgacaccagtcaaataggcttacatgaaaattgtatcaaaccatgcaagtgtaagaatatcagaaaaagaaactccttttttaatagataagaaatagttttcattaatttttaatgtccctaaccaaaatacttgttgaataaatgaacagtttttaaaatttcagaagtcaaacagtatttttatttatatttttaatattttaagactcctgtctcatttcttcaagcgtgaagtctcagtaaaagattgtcaataaaagcctttgtgatacagaatttatattaatattgtagattttttaaatgagttaaaaacccaacaatttactttatgttgatacatgcttatttgtaatgtttatgtcttaatgaaatccacctatatatctattcaaatatactgattgagcactactaagaccacaaatacaacctgataaaaagattgtcccagagagtgagaatttgtcgcgaaatggaggaaagacaaagatgaataaattaaaaattacaaatgagtataatgtgctctgacagaaggcagcaattgagctgaataaaagaatagaaaagttaatgtaatgaaatgtctaaatgaaaacactataacatccagttttctatactaatcactttctgcacaagaaaaatactaagcagtccatggatattctctacatatcagatcatatatttcagcttttaaaagttatatctggccttaccctaaataaaatgaaccagaattcctgggtatcgatactgctcctctaatcttaataaaaccctagctattttagtgagtattccacatagggtaaccacacatcttttcatcttgtttgcctcagatggtctcaaagctcgtgttctctcttccttgcatagtttttgcacagaggctgtcttcagatattctctttagtttatcttgccttaggaatcaatacacaggctgggcgcagtggctcacgcctgtaatcccagcactttgggaggcggaggcgggcggatcacgaggtcaggagatcgagactatcctggctaacaccgtgaaaccccgtctctactaaaaatacaaaacattagccgggcatggtggcgggcgcctatagtcccagctactcgggaggctgaggcaggagaatggcgtgaacctgggaggcggagcttgcagtgaaccgagattgcaccactgcactccagcctaggtgacagagcaagactccgtctcaaaaaaaaaaaaaaaaaaaaaaaaaaaaaaaaaaaaaatctatacacagggttctgtatatcctttaggattctcctttaatctcatatacttttgtagataatccttttattaaactttcctaaattacttgcttttcccgaagattctgttcatcatcattatacacaaatgttacatgagaatttcatgcttaaaataagttttctcttttgaatgcaaaaatcaatatttttctcttcctttcatagacattgtaatcaaagataggcaacatagcctaaacatttatatattaaagtgaaagtttgggcaaaccattttattaaccatgaaaatggcacagatttgttttcctaaaatgaccaaagcacgtgttttaggattaaaatagtgcctgaaattccaaaggaccaattttaccctgagaaacaagttcagttattttcaaatcattttatttcctaactttaaaatgatcaattgattgattgtttctgtgtctttgttctggaaactattatatcgttggtatatctaataattattcttacaaaaaaggaaaaatgtactgcagtgagaacacatactctttttaagattactgggctactgcttacattcttgcctcctccccttgaatctagttttcagacattagaaaagtgtatccaaatattccttaagtattctcttaataaaaatcctgctgttttctatttgagcttcttttcccagggtagattacagaatctacctcatctacagaatttagaaacattaatgacttcagatcaccagggtatcatgtaatgtccagcagtaagttgttagagactgaaatatgactgaaattaaaaattgcttcctgagatttggagtttaaagctgatttgagcaaatggatttgatccatagtagcatcataggctaatttaatcttgctggaaaaaagtgtaatatctgatatgtgtcgaatacatatggacgagtagaccagtgagttccaacctgactcgttattcttattgtgtcaaataaatagtatttgattattaattaattatattttaagctgagtataaataatattctgaactgatcaagaaatatctatctaatgtatctgctaaatttagaatatcattaatatctggaaaagatgaaatacaaagagtgcactttgttctgagtaactcattactgactcattatcatcatcaaaaagaaactaaagtgggttaatgaataatcttgcctttgactgtactttgtgcttctaatgatcttacctcaatgagaaaataaaaatgcttactttaagatctgtttgtaggattcccttaggaagacaaccttctttgtttaggaatacaccttaatgagtgtttttggttttgtaattaaggacttctgtgcgtattctaaattggatagagcaagaaaaacagctgaaatgctttttgggagaaaacacagaaaagtaaacagggatttttacaggatgtaagcaaattaatcaagaggagatgggaagaagaaagccaagaaatgtggtgataagagagcgttcaagataggggacttttggagttcctattgtgttgaaaaaagaagccattttctggagatcctagtagaaagtagaaggactagtgatagcagagatgacttttatatctgtacagatttctcattctgagtaataaagcacagctatgaaaatatgcccaaagtagacttaataatatttgttgtaattaattttatctgcaactgatggatgaccttataaagtaaggagctcataaaatagagatattcagagaaaaaaaagtctaaaataaatagaaaatttccatattcctgcattgtttttatactattttaatgtttagtattatctgggcttacagatctctgaacatatttactacaaaatacatactttgttatcatagccaagtattataaatagcagaaacaaagttcagtgtgctagcaggagatgtagaagccttggccaaagcaagataaaaagaagaattaggatctgagaacaggtcaatttttaagagatgattaatgacttttataaattacgttcttctaaatttcattgttccattttcactagattacatagaaatacaattttttttgtatattgactttgcatcctgtaacattataaaattgaagtatttgttttttaggtttgttgtagaattcatgagtattttgttgctgttgtttgtttctgagacaggatcttgatctgttacccaggctggagtgcaatggcaccatcatagctcactgcagcctcaaattcttgggctcaggtgatcctaataattcagcttcccaagtaactaggactacttctattcctattttgaaatttatcaaacagactttattatgaatgttcatagaaattctatttacaatgcaatttaaatataatttcaacttagaatctgaatatctatgagacaatggataaaaaatgattggatagtgatgatatattcatacaacagcatactcggcaataaaaaagaaagaatagatgtacaaacattgataaatactacaggcattatgcaaatcatacgaaggtaggcacaaaagagttcacattatatttcatttgtatgagtatctaaaacagtaaaactaatatatggaaatataagttaaaaagatgattgtctgaaggccaaggatgagatttcactgggaattgacaagaaaatattctcagtggtagaaatgttctatattgtgattggatgctgtggtatagatatatacaattatcaactctcataaaattgaatatttgagtgttatatattttaatgtatgtaaatgatacctcatttgtaaaagagaaaaagcaaactaaaaattaagaaaggaactttgcaagaacatgttattctaatattggtctcatacttatatccaaagctgtgaaaggaaaattggtaagtttattcagtagtagattttctttaaataatatgcttacacttttagtacttaacaaaaccagaaatttttaaaaataataaattgatgagtagaaccacattgttgagagcagaggaatacagctctcctttgtttaattttttcaaatgaggataaagacaatatcccataatagatagcattagtgaaaaagtatcctgtgtaatcaagttatttctatgtttaatcctgatctttagtaaaaatgctttgctgatctggttatagtgaatatttagcacaaccaattttattttgtttatgatatttttgtgtgttcatttatgcttaaataatagctttctggtttcctttttaaactgttaaataattgtcctgtttatttgtccttgtttgcaaacaagtagcctctccaatttcactcaacatttaacaacttaaaaaatctccattagtctgtaactggccacacttaagccactcaaaatggtcatgaaaagagaccataatggtcatgaaaacagaacacagatatccaaaacaaagagctgtataccccaaaatatatgtttttcagtagtctttacaatacttgtttttactttttaaatttctctagggagctgtgtgtctgtttcacctccgttcttgtagattagatgatctccactaatgcactcatcattaaaaaattgcaagataaccaaattgtttggtttgccatggcataagtttaatagcttgtgcactattatcaaaaataatgacactcttgtaggtcactgattcactgttgagacattaaagtcctatatagccatgaagtgaaaatggcacatttgattttgtgcctagattgttagatacagaatataaaaattatgcttagtactatttttctgcattgggttcaaattaacctctttatgtaaaagttaattttgtgattttttattgtacagtacactttgaaaagattttgaagatatataagctggagaattagaatataatcaacatgaaattcactattcaatgagagctagcatttaaaatagagataacattgtttcaatttctaattgcaaattgcagtgttacctctaaatgtgattttatttttctctaacttgcatggctacataacatgctatgatacttttctaatactctaaaaagatataacttaatttttttcctctggagattagatataaactttgaaatactagacttggtgtgtaactttttactcttcatcttcttctggaggtgtagggtattcattgctattgcaatatagaccttgtgaagttactgaaagcctctgagtacttgtggtcaattaggccatgttgtggtgactgatcgatgactttcataggatggtgatattctggaaatttcaactttgccttaatagtcctctgttctttatttaataataacacaaataattgcaagtcccttaaataatgtacctttgtccttaagcttaattttgcctatatgcaaccaagcaaagatatcttcaactcaaaaggtggaaaatgtaataattgatgaaaagatgagacgattaattgggagggcagatattatcaaactacaacagagatatagaagctattgtgtttttgcaaagctgttcagagacaaagcatgctgagttgcaattgaaagccatctctgatcaaaagccagccatttttacatgcagtgacattttctaaaacagaatatacagttttactttggaatatttcacatcttgttttattcatttgttttatacattctctgttctgttttaatatgtttagctctccttttgggtagacattagtgaattacatcaattgagatatgtaaattttttttctattttaatgtttcttaaattaagatgtgtttttaaaatcggcacatgtttaatgcagcttttcttttttgaaacactttcattgagttgacaggttttcttgcaatagatagcaccttagaaatcaagagaaaagggttcaataaactaacaaattcaataactttaacattcagtaacttttacattcaataactttaacattgaataacaaattcaaaaactttaacattcaataaactttaacaaatatttattgagtgtgtctgctctgcaagggataaggctaggtactaagaaaaccacagcaagaaggacaaaccaggtcttaatcttctcagagttcttgaaagtagagtaaattaaataggctatagtctagtaaattaccactgtggtatgacagagatatattttaaatgctataggataaccagagaggcaatgtataattctgtctgtgcttttcagaggagaaggaactctcaagtggaaggataacaagcggaagaaagaacgtaagcaaaagcaggaaggtgtgaaatgtcagggtgtgtgctgggaatgatgagtagtctagtggaactctagttagggcactttctctcaaacatgagtaatgaacagaacacgttaaaagaaaaaaagatcttgccaatctacagtattcattcaaattatttttgttaactttacatatgtaatatttgtttttacaacagttaaactccaaaatacatctattcattaaaaataaacaacctcacaaaaacaattaaaatttaattatcaacattaactaaagtcatatgtgagtttttattttggggcatgatgagcttaaactaaacaagaaactagctttttcactagtttattcactgatctgtgaattgaataggccaatcaatttaagtacatgtcaaaatatcacaccataataatgcttagcagctagtgttattgagttattatatgtcaagctctgtaacaactgttttaatccagtatcttattattctttaaagactttttcaagtggcttcccctacggtacttatactttaatggatgtcctcttacctctctgccgccgccttcttgagcatcgttgtagctttatcctcttctaactttctaatattggaatatttaagggttccattcttagttctatatactctgtcttttggtgatctcatttagtttcatgagttttatttttctttatatcctaacaaccaaactcatatattaaactagctccttgatgtcagcacctgggggcctagcaaacatctcatactcaatatgcccagttttaaactactgatatgactgggaacggtggctcacgcctttaatcccagcactttgggaggcggaggcgagtggatcacttgaggtcaggagtttgagtccagcatggcaaaaccccatttctattaaaaatgtgaaaattaaccaggcatggtggtgcacgcctgcaatctcaaatactcaggaggctgagacagtagcatctcttgaaccaagggaggcagaggttgcagtgaactgagatcatgccactatactccagcctagacatcagaacgagactgcctcaaaacaaacaaaacaaaacaaaaactactagtatctccagacctatttatgtttcagtcttcaccatctctcagttgatggcaattccatttcagttattcaggacaaaaccttggaatttttcttgatttattttttctctcatccaagattcaaaatctttggaaattaatgagtttatattcaaaatatatccagaatatgaagcctcttctcacgacaccctctgttgccattcatatccaagcagccattattatcattacgtcttgtctacatttttacaatagcatcttcctaatcagtgtccacattctactgttgttctcccacaattcattgcaatggattctcaagaaagttgccagtgtcttcattctattatgtaagttatatcaggatgtgactcctgtaatttgaaaatcaaaagctttttttttttttttttttttgaggaagagttagaatttagacagtagcctacaaggctccacatggtatgattccccaactttctttttatagaatacagcagcagtgtacctagtgtgcatttgacacatacattggattattgtttagaacttctctcacctatacaacaagaatataattaataataataatgaaataagtaatcagaatagccaggaaataaaccaaaacaatataaaaattattcaacttttgtcatgattatatatacatatatataattttaaaaatattcttagaaaagcaaatagttaaaaatacttaaaagcttaatattttaaaattatatttatacttttttgaaaaaaaggaagcttgtatctgcatttatttggttataatcataaatagtatcattctgttttccagctttaacctctgcatactgtcaatgactttgtctagattactctgctttgcatattcataattaatagaggatttaaacagatatgttgatctgtctatgctcatatttggtcagaggatactttttattggttttaattttttatagtttctttcatatcaaataagagatacacaaaattagaaaaacatttaatatgcagctaaatttgaaagagatgtataaaaatcccacttcacaataaattccagaaaattcataaaaaacaataagtggttacattgaaagtgaaataaattttgttttctttttataattacaatataatttatgtttatatagaattaactgagtttttaaatgtattttgttgtggttaaaaacacttaacataaggtctaccctcttaaaaaatttgtaagtgtactctacagaattgttaattataggaataatgttgtacagtagatctctagaatcgattcatcttgtatcattgagactttacgcccaagggggagttgctgacctgatctactgtttaaattcaggcatagttaggaccaccacaggcactggatttataaactgtgccaagtgggtttaaagaatctcagaacttcatgaatttactcttgattgattatataatgaagttgtctgaattagcattcatatagaatacagtgctttatttcattttagtgatacataataaaacatgacagtttgaaactaataagcaaagtattaaaattcaaaaaataaccaaatcagttttttagagcttagatcaataaataattttttcagaaaaataatttttcactgaccttgttttgagtcgcctgcaccctgttggactgttcctactgttccacctttggtaggccactgaattttgagataagaaattcaagataaatgttccgtatttaaaagaattttttaatacatttgcagaattcaagttctgcttcactgcacttctactttagctgaacctttggcctataataaatatattctggaaatggtggttggttaatagaaaaagtcctttaaagtattagatttgttgccagtttttaaatatatgataggggtcaagaaaccaagaatcacagaacaaatatggcctgccaccagtttctgtaagttttattggaaaatggccatgctcattcttttacatattgtctatgcagctttcgagctggaaagaagaattgagtaattgaaacaaatatcaaaaaatggactgcaaagcctagaatttaaactatctgtcctcttatagaaaatacttgcaaaccccttcttattgtgtagaaagaatttggtgttaaagtttactttataatgaatttatttattgaactgtgttaatgagaaacagaaaagcaaataaaattgatctagtttggccagattgtatgcagtgaatgatttactatctgagaaaagtgttactgaggcaacagtgtttttaacatgactgtgaagtcaacagaggaaagatgtttatatccatggtgtgagattatgaaacattaactttgcattttcattaatattggaaccaaaatagcttttattgaggaagaatgattgaagtgttagcatccatacaaggtagagtaacaggaaataatttatcatgagatgatttataactccactttatagagacgaatattttcatggtacaaatatttcatatctggaaatgattgtaacaaatatgattttcccccttcagcataagttgtatgagcagcttcaccagttcagtgatacaaatacggttgaatattgcacttgtccaattaattgcatgagttatcccctatctattttaccaagaaggttaatatcaactttttgaggtctcaacatccagaattgctgtttgtaggctttcttagtctaaagaacacacagatggatagttagagagcccaggaagtacacaaaagttcccattttcaaaatgtctctgcatcctgttgttgctccatgttctgctgtaaattgctcctgaattttcagtattctgtgggttctgatgtggacctctgaaccttgctccctttcttcccaataggctgcttgaactctaaatttatctagttcctcctgtacaatcatttccatatacaaaggaacaactgtgtagagcagatgttagtcaaaccactgaagttcaagttatcccatttcccattcatagaatggtgattacttgcatacatttgtgtaagtgagagggccactgagttggtgcctaaaaagaacattttcaaagtaatactgggcccaccttgccaaagtggtgggcaagagcttcttgtttccaaaataatatttaatatctacctcataagatatattttaagtggtattactaggaattataattttatatttacaaatagcatgtgtgttttagttataagagctgccaaaatattttaaaagaactacttctttaattgagaggaaacagtgaaattaagacaaattataataaaggaagccatgtaaagattgaataagctttatttgcttaatgatatagtcacagatatccacgtgtattcactattttcacatattgtgcctcgctattatttgtgtgctcaaggtctctatcttcaagtgttatatactgtagagtttcctatcaaatatgagcataaaggaatgtttcatctctatctttacagtgtaatcttaaaactgctagctactattggcttttctttctttttccttttcttccctttggcttttgtgttattgttgaaatgatgtatctattccttttagcatggcttatactaggagctctgaaacccagttcagaaacctgtgagttatttattgatgttaacaaaagttaaaatcaataagccagacataaaaaagaaacttctagatctaagacgaatgtttagttaactttgaataccgtatatgaaattctcaatattttcctgccagatgttcatgtcatagagttagcaaacagttattgaaaacttactgttgcaaagttcttgggattcaaacctaagacacaaaagaccttcaggcaatttgcagtccaattgcagaaactggcaagctgaaaaggaattactgtgtattatatgttttattattggatagaagtaacagagagtgctatgggatcacctagaaagagcaactgaggaaattgtagatagcaataagaagagccaattgtcagaacacagttgtcaggctgactcttgaaagatgagtagtaatcagatagacaatgccatgccatgagaaagcaattaaaagaagttggaaattccatgttaaggacacagaaagacccaaagtgcatggaaataaacaagtgttggccatttagagagcacaagtggtttggaataactagaattcatatttttgttttaaagtgtcaagaaacaggccgaattagggagaaggaaccaaatcatgaaagaccatatccagaaataaaagtttttctaaagataaagaatgaagttgaattttaatgacagtaacacaatcagatttacttttgtaagaattacattcagagaatagtggaagtcagagtgcttgcgtgcatgtgtgtgtgtgtgtgtgtgtgtgtgtgtgtgtgtgtgtgttgagtggggagggaataattttcatactccaataagaaatgttgaagacttgagctttggcaaaatttattaatttatgaggattttgagcctttcatctcaccctgcccattaaaaaattttctaaatttgcctttataccatctcttctgcttactggggcgatttcagagctgccacctggctggaaacttactcacataaagcaagcaaatccctcaaggggccatagcaaaggagataatctgctcatgggtcaatgggaggtgaaataaaaaagaatatgcagaagaaaagattgaaggttgttgcctggaatgattcctgaagccaagcatcttcggttgttattttaatacttcctttggacactgaaggttggaactgttaaaaactgttaaataagaacatagagtcaatgagaatagacaaaactgttaattcatttgtctgtggaaggaaagaaggaaggcaggggctagaggagtgtttggaaaaggtgaatcaatatttattaaaggaaggaagtgggcatttccaagaatatattttaggataaaaaagatgtgggtatttttttataaatatatatatttttattattattattatacttttaagtttttgattgagggtgaatcagagagggacaattttaagttctaggatggtaactgactgtggaagatttctgtggggaaagcaaggacatctagactattggtagaagaatcctggagggatcattcaatgtgatttaaatttatattcaaatatacttttaatagcaattcatatttttagaaaccgctcatgttggaggaaggattccatttatttttgtggtattttttaagcagagttgaagacccctatgaagaaagtatgaggaagcatttatgatcaaaacggggaagaacgttttttgcccaaagtgacaatagctgtattgtttcctctgtctatataagtaatatatgctaattattaaaaatgaaaaaatgacatagaaaatacaaatacttttgaaatttcaatgcaaaaatctttttgttgactatctttaatactacttgctcactctctgtctctctctatcccctacacatacagcttaggtaagtggcatctcatcatatgtggtgttttcaccagaaataattttataaaaacagcattcaaaatatggcttattttatttttcccctttttcttactctctctaatcttacctgtttttgaaacagataaccagaattaattacaaagagaaatgtatttaaattcaatgcctgaggtggggtatattctctaggtagtcaatgtttgtttatttccatgaactttgggtctttctatgtccttaacatggaatttccaactccttttaattcctttttcatgccatgtaattgcctagctgattcctactaatgtttcaagagtcagcctgataacattctcaaaagtgattttgagctgattttctcagaatttccccttgctttaacgaaaacaaaagaaggaagctcaggaaaaaataaacaaacaaacaaaacaactttttgctatctaagaattttcctttaaaatgaatttggatttcttggatgtcttataagataaatagtttcctactatcagaattagtcttagatatatttgatgataatctctcgtacattccatagactcaatttctaaattgagaaggaagttgtcctagagcacttgtaggtttctttccaattttatgtttttattggagctttatatccaaccctatatccttagaatcttcattatttgtaaaattatgaaatacagcaagtgatgggcaatttgtgttatcccagttttaaaagaaaaaaaattcatataaataaagcattttttagaagtcataaaacagttctattatggaagcagaatataacttaaaactataaaaactataaacttttttcagtcttctaatgtttccacttgcaaaataactgagagaatgcaaaatttgaatatagtgtacaatacagtttttctcagtcttttccactttactttttaaatcgcaaaagtaaaacctgtcatggttaattttaaaaagtatacaactaaaagtaactttccatccccaaaccagaacaccaatccctacatttagaagaaaccactcttaagaaacctaatttatgcatataattcaattgtgtaactatagcaaagcttttaaaagagatttgattacaaaacattttttgcaaaatttactgtatcatatccatgttccaaaagcaaactaaaaagatctcaataaatcttccctgtttactgaattacattgaaactcctttgcttagccttcaaagtctgcagtctgaccttactttatctttttagtggatctcctgctgcttttttatatgtgtgtagtgcactcatcaaactgaatattttatgaaactgctcatgcttttttaatctgttaaaatcccttctttttcactaacctttcaaatgcaactatctccataaaatgtactggataccagaaaaagattgtgttttcccctcttgtgattaaccataatacaaatgggtacacattatgcatataaatgaataaatatatctttcaaaaggtattacataatgtagtttcttgcattatatttgtcattatggttgtatttgtcctttaataaattttacattttcagaagagtcccattattttacattttgcacaccagagcacctacttagagtagacacaatatatatccatctttttttaaaaactctaagttctgggatacatgtgcagaatgtgcaggtttgttacatacgtatacgtgtaccatggtggtttgctgcacctgtcaacccatcacctaggttttaagccccgcatgcattaactatttgtcctgatgctctcccttccctcccctgccctgctgacaggtctggtatgtgttgttcccctccctgtgtccatgtgttctcattgtttaactcccatttatgagtgagaaaatgtggtgtttggttttctgtacccgtgttagtttgctgaggatgatggcttccagcttaatcaatgtccctgcaaaggacatgatctcattctttttatggctgcatagtattcagtggcatatatgtatcacattttatttatccagtctattattgatggtcatttgggttggttccatgtctttgctattgcgaatattgctgcaataaacatatgtgtgcgtgtatttttataatagaatgatttatattcttttgggtatataccaagtaatgggaatgctgggtcaaatggtatttctggttctaaatccttcaggaattgccacactgtcttccacaatggttgaactgatttacattcccaccaacagtaaaagctttcctatttctccacagcctcaccagcatcagttgtttcttgactttttaataatcaccatcctgactggtgtgagatggtatctcgttgtggttttgatttgcatttccctaatgataagtgctgttgagtacttcatatgtttttcatatgtttgaccacataaatgtcttcttttgagaagtgtctgttcatgccctttgcccactttttttttcttgtaaatttgtttaagttccttgtaaattctgtatattagatctttgtcagatgggtagattgcaaaaattgtctcctattctgtaggtcacctgttcactctgatgatactttcttttgctatgcagaagctctttagtttaattagatcccatttgtctattttagcttttgttgccattgattttggtgattttgtcataaaatctttgcccatgcctatgtcctgaatgctattgcctaggttttcttctagggtttttatggttttgggttttacctttaagtctttaatccatcttgagttaatttttgtataaagtgtaaggaatgggtccagtttcagttttctgcatatggctagccagttttcccagcaccatttattaaatagggaatcctttccccattgcttgtttttatcaggtttgttgaagatcagatggttgtacatctgtggtcttatttctgaggtctctattctgttccattggtctatatgtctgtttttgtaccagcactatgctgttttggttactgatgccttgtagtatagtttgaagtctggtaacatgatgcctccagatttgttctttttgcttagaattgtctttgctatgtgggctttttgggttccatatgaattttaaagtagtttttttctaattctgtgaagaatgttcatggtagtttgatgggaatgttattgaatctgtaaattactttgggcagtatggccattttcatgatattgattcttcctgtccatgaggatggaatggttttccatttgtttgtgtcctcttatttccctgagcagtggcttgtagttcttgaagagctccttcatgtcccttgtagctgtattcctagatattttattctctttgtagcaatcatgaatagtaattcattcatgatttggctctctgtttgtctactattggtgtataggagtgcttgtaacttttgcacattgattttgtattctgagattttgctgaagttgcttatcagcttaaggagttttggggctaagatgatggagttttctaaatataggatcgtgtggtctgcagacagagacaatttgacttcctctctccctatttgaatacactttatttctttctcttgactgattgccctggccagaactttcaatactatgttgaataggagtggcgagagagggcatccttgtcttgtaccggttttcaaagggaatgctttcagcttttgcccattcagtatgatattggcttggatttgtcacaaattgattttataattttgagatatgttccatccatacctagtttcttgagagtttttaatgtgaagggatgttgaattttatcgaagctcttttctgcatctattgagataatcatgtggtttttgtcattgattgatatacagaagaaacactaagacctccatttcagcatcatctttgaagaataaatttcttttgaaaaataatcacctggaaattagcatatggtgcatagtttcatgtctttgttagatgacactagagtaatacacaggttctacctcttttcgggataactaaaacagtgtcagagggcgtaaaatactttgagacatcaacttgaaaaatgtcattttcattttgtgatgatttattaaaagcccaattgatttaaaattttttattttctgttttaattgtatttctcaatttatattttaaaaatatctaacaaaaatggatatttaaagaaatacaccttgaaattaaaaaatgtgcagatttcataatttttcacattttcctggcatacggaagcttttagaaacagggaactaattcattcatacaaggtatgtgatatttgaaaataattttaactatctcattgacctttcatttttgtttacctttactctgaaaactttgggtactcacctttcttttttgtcttacatttttacagtcttaagcagtttaatattttcttttctgcttatttgtaacctttgacgctttttcagcattacagccagaagcaaatgcataaagtgtctcttcagatgtaacaaggatagcaaaaccactgggctaccggttacaagttgttattagtattttgtaatggaaagatagtagactttgaatatagccaaatagaccacttaactactcactggccatatttttttaataagttgtacttctctgaattttgtcttttatttgtaaaatattttatgtcattttgtgatatttaagataataagtgaaagcactatgcattatacaggtagatatttatttattgaatactgtttgcctgttctactagaaaaattgatctttgttcatggtatcctagaggtttttagttaatgagactattaatagcagcaaaaaaagaactccacaactctactaaatgcttattcagtttattgtttttcttttaggtttagtcatggtgttagtgtatattggtccatttggaccccagtctcatctacatgtgaataagcaaggtagttaaataacaaataaatatgaaatatcaacaatagttgtggtctcaagtttgcaaacatgttggtaccatcactgggtgtttagtttcagataggatggcagcattagaatgctgcagattctgtctgaaggaagatttacacaactgacaggatattcccccttgtaattctggtttggtacccctataatgtgatcatctcacaaccatggcattattggcatagttctctaaccaagcaaatgaagctgctatatatacacttaaatcatttggaaacatgactgtcatttacagactgaatccccttagtagtgcaaacataagtttacctatatgcacaacatacattattattcttatgtgtatctatgaatatatttctaaaatatatctgtatctatcatctatctatcatcaactatctatctattacatataagttatgtaatccaaccctcacactttccaaaaacacttcaaaccacagtcagtgatacactaaataatgtaattgcagttttgtcttcaaccttatcccatttttaagcatttattataatcaatatgtgttaggataattttggaatgttttccatggcattatgacccagaaatgcaagaaaacagaaatatctccctcttgtttgattggaatttctaaagaagctaaacatatgaagaataacctgtaagagcccaagtatgttttttattagtaactgcttgagtactcaatattctaatgcaaaactctaaaaccatgagtcctggaaccacttaggcttatggtctaagatgaggccgcttaccatccatgaaaacctccatccatatcttagaattttcctaccttgttttagaaagtacagaactgataggcactacagaatcatacagaaacatgtctctgatggctactctcaagcatgtagagggaggcaaaaccagagagaggaaatctgcaaggtcttttatgagggtgaaatcaatttattcactcaggtccataaaactggagcaaagtgtgacttgtacctttcacaatatggtgactataccttctagtaactatgagtaactatggtttatttgatgaaccaaaattagctaattggttcacaaatttaactactccttcacaatatacacgtgcttgtggaatgcaaagaatacagcttgggtagagaaattaactttccacttttcataatatgccaaatttctaagatttataagtgaggatagtatcatataagttattaacaatatgtttttttcatacacacaatttcagaaatggaaatgaatgatttttaaggttttgttttttttgttgtttttgtttttgtttttttttttttttttgagagacagtctcactctatcacccaggctggagtgcagtggcatgatctcagctcactgcaacctccacctcctgggttcaagcgattctactgcctcagcctcccgagtaggtgggaccacaggcttgtgccaccacagccagctaattttttgtgtttttagtagagacggggtttcaccatgttagacaggatgttctcgatctcctgaccttgtgatctgctcacctcagcctgccaaagtgctgggattacaggtgtgaggaaccacgcccagcctaaggttgctttttaagttttttttttttttgttttcaactttattttagaattgagggtacacatgcagctttgttacagaggtatattgtgtgatgctgaggttggggtttgattgaacccatcactaaggttgtgaatataatacctaataggtagttttttaaattcgattcctttttgctggaagccaacataactccattctaaccaagagccacatgcttaccatgtatcaaccagtagctacaataatacacagatgtataaatttgaaatttataaaagagttttgcggtccaaatgaatatgctctcttcagcttgcgagttgtagactatcattatcctaggatattgttcccatcatatgattagctcttcaaaattctaaccactttattgagcaatatcaagtcttttttatattcaatgccatttcctattattaaattgaataataaccattattcataattccattaattacttactttgactaaaaagcctcatcgaagctactaatggatctcctttcaaggcttgttaacatggcacctcaaataaaatactcaatgcctgatagctagatgcacttctaacctttctagtattgaatatacctcatcaatagtatttttaactgctgctgaggaaagtaggagatgcttgaattgctgtatatttagtttaatcatcaaagtttccataaagctgtatacattctatcttattcacatccacatgaaactgccctttcctaatacactcttttaagagaaataaagtaatgataacacacttttcaacagatgactcttatatattatcaaagatgtaaaagaaaatcataaacacaatgctatgaaaatcatatgattaaatttcctgaggagttagaaaaaattttaataactttaaaagaactagaattaaaaaaaatccagcataataatattcatagtttttctaacctagttacaattagttaactcctatttatccaaggaaataaaggaaaaagtgatttggaagttattcccttggataaataggagttttctttagggaaaactataaaatacccactgggggagcagtcttataagtaaaaggtgaatgtaacatataaagactatgccatctgttttcttttttttttttttaattattgattcagagagtaaatgcgcaggtttgttacatggatacactgtgtaatgttaagacttgagcttctagggcacgcatcattcagtgaacattgtacccaataggtaatttttcaacgcttacctccctcgcgcctttatcattttgctttcttaagtagtttacaattatgtattttttaaacatcaccccctcaaactagatgtttgtctttgttatcaatagaatacttgttttgggaaatgggagtaaaaattaagttagtgccttgtgaagtttatcaccaaatcttagagaaacaaaatgggaaacatcgaaaataactgataagatctgaagattatttttaattttaaatcgtatttgccaatattattgtcatttaacaagttaagcagttgcatgtggcaaacactgagcagagacaacagagacctgttatataatgtacttctgtagtgtgattcaggagctcccaggtaaggcaaagccaccccagaagtcatggtgtttcctcatgtttctagcaaaaaggtctaaccttggactcctgtgaattgagagaccttaaaacacattggcatttcttggtgggaatggggagacatattttcttgatttaagagtttataaatgatgtgattatttatttatttatttgaaatagggtctcactctcttaccaagtctgcagtgcagtggcaccatcatggcttactgcagcctcaaactcccaggcataagtcatcctaccagctcagcctccagattagctgagactgcaggtgcatgccaccatgcccgaccaattttctctattttttgtagagctaggatctggctatgttgtctatggctagtcttaaactcctgggctcaagtgatcctccagcctcagcctgccaaagtgctggcattataagcatgagccactgtgcctggagtgatttttaaataatttattttctaccacatttaggcctatatgacaccgtataaatttatcaccatgtatgtaatacttaagacaaatttctataaaattgaaatatgatgatttaaaaactgaaactttaaaatgttgcaaatggctgcttttcagtgtctttgagagtggcggtgtttattttgcaacctttttctggccttttacttcgtgatatctggtaaactttactgataatcaaggctgaataacataacatctacaatcagtatgtaatcaaatctgatgaaaaaacatttacacacacttatcacatatctatatatgtttttaaatgaactgtttttaagtactgctatttaagaccttacgcagtagctcttgaactggaaaatttattttttgttatcaatgtcctagtatgaatgggaatattcaaaattattctggtattcatgatgacatttagaatctaggttttcctgtttattttgcttgtctttgtctccagtctgatactaatttggaagttaatatgaatatttgtaggaaaaaactgcattctgaggagtcacttctaaatacttgcatccaaaatgttactaaatgaaaattaattgcttttcatgaaaaagggacattttacaagactgtgtaatcatattagaataatgactggcctcactaatggaaattaaatgtgatgctgggtgttctggcagggtggcctgggagctaggtttgcatgtaaaagtgtaatttctatccccgctgagtagattttgaatctcaaaataattagttctgtcaaataattaattttgttgacaggattaagtagagaatatacaacctcacacacatatattataattatttggaatgacaagatgatataaaacaataatcttcaattctggctctcaaacttgatcagatcatttctgtgagtacttttgagattcatgttaataaaccttgaatgtaacatataagtcatcatctatggcgccatttacatatggaattcttatcatagtcattaaatgtgctttatatgtgggtgtatgtgtttgtaggaaagttattgtttttataaaacactgcagttcaccaggaggtagttctaagcaaatgttaattttctgaaactctttaagaaagtgcagctatgtaaattgtgtgtttcttttgctctccgaagttagataacatttaaaaagacatattgtttaaaaatgcgtattgtttgcccttcaaatgtaattacatatctaatttaactttccacatagattttctagaacactagaagaaataacatttcttaacatacacttacatatgcacacaattaattttaataaatagccagtgtaattctctataaaactgaaatgttggtaatattccaataaaaatcacccacatgtatcctatttgacatattctgtgatgtcatggtcatttccataagatataaacataatatatatttcagagcaattatttgtagcagacagctggtaaaccaacatatacaaattggaaaatcactaggataaatatgagtgttcaagaaatttagattatatcgacccatgtctatatttaaatctatatttatttataaatctacatttatctgtctgtctctttctcttaggaaatatctctggggatggctcacaaatggcaatttttaaaaactcctcagatggttcttttgtatagccaggattaggacctatattaataaataatatattaataaataatatagatcctaagcctatatataatatcatattatgttattcataaataataaattgggatctatattaaaaatcatagaattttactcaagaatgaaacatgaagccttagaccattgaaaatatagtagccacttttccagaagacaaaattgattattgtaaaggtgtagatttttttcacaaactattttgtaatttatataacaatccaatcaaaataccattttttgacaatttggcaaatgacaaatgattctaaagtttttaagagtaaatagttatatttctatatgctattttgaaagaatttcagtaagaagaataaacgtttacacagatacatatatgtgtacatgacaattagcataatctttacatatatgtgtgtgtatatatatctatgactatataatatcttgtgggatacattgcagtccattaactgatcaaataattattcaataagtagtgctagaacaactggctacttttagaagaaacatcagatgtagtctcactctgcatgaagaagaaagtctataaatcccaagcatcccttgaccaagttctttttattctgagaacaaattctgagactaaaaaaccaagatttatacttaattgctatttgcaacaggagaaaaataagcaactctaaatgtccaataataattaaatgcttgtgataggagataaacctataaaaaatagaataaaaaaggtttctttgtaaaaagatgactaagaaataaattggaaagaaaatatgacaagagttaattatatttgtcttgaggttatttttcttcctgtgtgttttcagttttcccaatctccatgaataagcaaatatgaatttataatgagacaaaacaaaacagaaaaaaaattataccaactactatttattggagttaatttgttcataaaaacttggaatttcatcgagtattgtaaaattacctaaataatggcttgataaattttgctgtatagacatacttaatagtattgaaatgcccttttactttaattaatatatttatttctgcttcaatcaaagacccactctttaaaaaaaaaaaaggaaaaataatttagagtataatttgaagaataaacccgaaagaaggttttgaaaggaaaaatactggagaatcatttgaataatcagttttagtaatggaataagaagaaatattggcacgggaatagagaaaaatatactgataagtattaaaaattccagagcaaaatctatgtgagtttttaatatgtaaaaaggcaaaaagggcctcactcattacttttctttctctttttttagagacaggatctagctgtgttacccaagctagagtgcagtggtaggatcatagctcgctgcagcctcaaactcctgagctcaagggattcttcagcctcagccttagactcccaagtagctggaactacaggcacacaccaccatgcctggctaatttttttttttttttttttaacagacagggtatcactatgttgcccaggctagtatcaaagtcttggcttaaagggatcttcccaccttggcttcccaaagcactgggattacaggcatgagccaccattcatacccacttcacttcttttcaatagaataaataatattgttaatagataacattgaaatattgggccatctgtcagaaatcaattttatttctaagcctatagaaaatgaaagcaaggccgggcatggtggctcacacctgtaatcccagcactttgggaggccaaggagggtggatcacaaggtcaggagttcaagaccagcctggccaagatggtgaaaccacatctctactaaaaatacaaaaattagccaggcgtggtggcaggtgcctataatcccacctactctgaaggctgaggcaggagaatcggcttgatgatctcctgctgaggcaggagaatcggcttgagtgcagtgagccaagattgcactgcactcaagcctaggcaacagagcaagactctgtctcaaagaaaaaaaaatgaaaacaaaccaaaaatatagagaagattataaagatccaaaagtaaagacaaaataatcaaatattagaaaaaatatagggatattaattcagacagacatgaaatccaggtgatttaaagaaaaagatgaccatacctgattgcttgggaatataaattccttgcagatgaaagtcaccataaggaaagagagagaatcctgggagatacttaactaaaataaaatagttactataaagaacaacattaaaattgataggaaaaataaagttttaaaataggtaaatgttgtttaacaggcaattcaaaaaagaaggaaaagcaaatggatactaaagagatgaggttaaatatgtttaatagaagaatataaaaggaaataacaatgacctattcatttcaccaatcagattgatagaaactaaatttttgttcatattgaatacttttgtgggaatggggaaattggtaccctcatgtaattttcgtggaactgtgaaatgctatgaataataataattttggaatttaagagagcagcatctaataacattttgactgtgcatataactttaccctataattacttttgataatttttgtacataaataaaaggccaacatattaatatacatgtcaaatattctaaaaatattaattctgctggcaaaaatcaagaacagtttccatggtggttacatagggaatggctaatcaaataatattttatctcttataggaaaaaggcaagatttaaaaagaatgagtaactgtgcagtagcctgaaaagatgtccatattacattgttaagtaatgtaagcaagttgtacataatgtatgtgatatgatgctccagggttttagacactttatggagtgttgagacacacagatggacacataccaagtaaagctatattaaatttcaaatttagttagttaaggataacaaatcagtgcagaggagtaaaggcagaatacttcagtatgtatactcttggccccagggtcacaagctgggagattgaaaaagctcaattattgctacgcccgcacccctatttttctcaacatgtaagtcaccaatggggaagaatttaaaccatccatctaagtgatgctgtgtatgggaatgttacagatattgggctgtcttgcttgtgtcccaaatttagtatcagcaatacttcactctcatcttagggcagaaaggggagtcagatgccatgagtgcacgaacaatacacctgcctccatcttttcagcatcctgagattcctatttgccatcaatctgcaccttacctcggtttagtatccagttcattttctttctcatatcacagtttgatctgggctctgagattccagaaacattttccttatgtgacaaatttttgccttaaaatttgataccttcttatacatgctcctttatgtttatatgtgcttcaaacaagataaacaaatactcagttcatattttaatctggggaggagagaggcatgttagtattggaaggagtcatttttatttatacattttctgtgttgccatacatattatttaccaacaataaattgtgttatttttgttggttaaaaatatttagaggaaaggaaataactaaaataaaaacacatacagaataatgtgaacattttatatatttttaaaatttcaactttgattttaggttcaggggatacatgtgcaagtttgtcacatgggtatattgcacgacactgagggttagggtatgaatgattccatcacccaggtagggagcatagaacccaataggtagttttcgatgatttaatattaaatggaaacaatctaaaactgcatgtgattagacatatttttaaatggtaaagttagaatagcatgctagaagttagaatagcaagctagacgagcaagcattaaaattttaataatattattagatggtaaggttaaagatataaatttcataaaaatgttggcatattacctggtatagggtgacttttgatttattttgtcatttttactcatattaaataccatgtgtgctaagtttttctgatttttgtactttccttacacatgctagtgtactgtgaaatagaactccataattagtattgtaatggtaggattgacaaacctaacaccgattaaattgatcacgacattagaataccattctctggaatttctggtttatttctaagcatcataattacttttccctgttttctaactaggtcaccatgctgtcagtaatattttcagtgttacagctacccaggttttataataattgccttcatctccactgcagctttataaagaaagtgataccattatcccaattatattttacaaatagggtaaatgaagatcaggaaagttaaataactttcataaagacgcacagcttatagagtacattgttgtcatttgaaccaaggccacctgattccaggttctatgatatcaatattctgtgattacatccataagttaattcatagaaaaatgaagttcttctaaatttgctttctgtaatataattactatgaagtttataattcaaattactgttttctaaaatgctaataatcaaaatattttgtaaagtattcggttattggatgtttcaggcttggaaatgtatttagttgttctaaatgaaataatggaaaggaacttaagtgtttagtttttctgaatatcataaaaattttaaaaataattttaaaatatcacaacagactaattttgagttactttttattttatctaaaatatgataaattttaaattatttagcatattaagaaatcttcataatatccctgtactgagtttattttaaatagtttagttgaactagaatacaagtaaaattttacctggttgaaatattatttttttgattgacccctttaagcctaagcaactgtgcactttaaattttccagataacagatattttgctctcttctgaaggtaacaaaggtaatgaaagtttttacatctgaaacctgtcacggcacagcccaatttaaccataaattgtatgtatttatgtaatcagagtaagactgtcatctagctggcacttacctagaaagtaccatatgtactttcacaaagtgcctagaacttactataatcatttttattgacctggtaaattgacaatagtagagtttttattgttcaccactgtttctactctgcacttttcctgccccatctccttttcttaaacaacaacaaattctgcagttactaggatactatcaccaaagcctatttgtccatcagatataaaactacaattatttgtgcataagtttctcttttgattttttcttattgactgcaggtacacagaattaaattcataataattctgggtttgtgaaacatgaacatcattggtccatgcatgacccattttactataattaattatttaattactagataccaaagtataattatgaattcagtaggtatgcagttctaaagtaagacaacgcccagaaattgtggttcggtgagataaacgatcaggcttttagtctgaaagtcaggctgtagcatctggttagtatgttgcaattaggaggaaataaaaaggtctacctaagtacgaagtatattaatttgccatcaagtataaattgtcaagtctcattaagcacgtagagtttttgtttgctccttgttgctctgtgacacaggagataagctcaaatgactttatagctaacagaggtttatttttccctccaaaggcagagcacatgtttggcactgagaagatctcaccttgtatccacagaggtttgcactagccaatggctgtggacactgttgtcaataattacaagcagtttatttgagtttacatttcatacagtgattattaggtcctgaggacagtacatttcacaattagctgaaagacagttgtagccttttgttctggcagaccctaaatacattgctaatcctttctgaaggaggaaaattaagtatgtatttaatgagttgatagctggaagtagataaatgactgacatatctaagcgtctatgtcaaagaatcgaaataaacacttgttaacttgatgcattagagtcaatatgttcttttcactatcattgtaaagggaaataattagaaaagaataaaagaagttatattagacacatgtaaaggtcttacagtatttcaaagagactattttttagagattattatccctcagatttgaattataatagcatgtgttgttcaagttcacatgccttgaaaaaaaataagatctctaatttataaacaggataaacactcatccccctcaagtgcttgagactatccttagcaaacagtgattgagttaaccctatggcttatactaagctgcatcacacataggaaggctgtgtaagtgctaagttaggtcttagttggtcttggacttagccctttagctggatgatcaatatctccaaatattttagccttagttcctttctgtaaaaaacagcaccaacaatacaagttccatctacttcacgaggttattattagaatcaagaagataataatggtgaagtattttgtaagatttgagtgctatataaatataaaacataatttaaattaaaaatcttgaaaggatctgtagtgtggcatatatgctgattattaaaacttcttaagttagtactgcatgccaagtactgcacaaattatatacatatatatatttttttaaaaaaagatgaatttttccaagcgtttatgattgggttttatcaaaaaaagtgttaaccatttctacttggaggaaattgagaatacaacgttgttaaacattttgccttagattatgattctcagacttctgctattccccttataccaggctgatgatgcattataaaaattataataaaaacaatcttttcaaaaagtcgtgtatatttttatagaattgaaggattaattgtcactaggtttttagaaaggaatgaataatcattaatatgtaaatgaacataatgactgtttcttgaataactaaatttgcgattccaaaaatatttttctgcttatacttttgcttgtttgtatactttaaaaaaatgtacaaagcatgttgactacatacatattatatcaaaaaagatattctattggagaaagagaaattcctaaaaataataccttgtattgtgtactacgtttattgaagtaagggaatatctgcctggatgaacacattctttgatgtatagaccacttgggttcatgcatttgatttaatttgctgggtagcaatttttttcccttattttcaatgtgtctttgtagaaaaatggggtgcctcaaagagaagaatcttctgagaatgagaaaaatatcccttgattaaatgcatttatgatgctctgaacccttgtcaaatcctccaatattgaaattttgaaataaattgtactgctgtatgaggccataattgcatgatggaattgcagacttttgcgaacattttatcctaggctttggtttgtcttctcattctcttgacaatgtcttctgcagagtaggggtttttaaatttaataaaactcagcttatcagttatttgtttcctggatcgtgccattggtgctgcatctaaaatgtcatcaccaaatccaaggccatctgtatttcatcttaggttgtcttctaggtgttctatagttttccatttcacatttaggtcaaggatccattctgggttaatttttataaagggtgtaaagtgtttgtctagattcattttttgtatgtaggtgtccagttattccagaaccatttattaaaaagactatgttatggtctatagttttgcttttgctactttttcaaagatcagttgactgtgttcatatgggtgtatttctgagctctctattctgtaccactaagctatttctccattcttttgccaataccagtctttattactgtagctttatattgagtctcaaagttgggttgtgtcccttccaactttgttcttcaatattaggttgcccattctgggaacttagcctctccatgtaaagttaggaatcattttgttgatatccacaaagtaatttcctggaatttttattgagattgcattgaatctatggataaagttgggaaaagttggtatcttggcaatatctatgaacatggaatatttctccatttatttagatcatctctgatttctttcatcagaattttgtggcttttatcatataagttgtatacatattttgttcgatttatacctatggtaaatttacacttgatcttagccaaaaggctgagaagcgatccctatggcaaatttaaatactgtatttttaatttcaactcctctgcactgatttgttatccttagctaactaaatctgaaatttaatgtagctttacttgatatgtgtccatctgtgagtctcaatactccacaaagtgtctaaaaccctggagtatcatatcacatacattatgtacaacttgcttatggcttccaagaaatcctcggtagcaatttttcaccatgctctgatcaaaaacataccagcttcagccaggcacggtggctcacgcatgtaatcccaccactttgggaggccgaggtgggcggatcacctgaggtcacgagttcaagaccagcctgaccaacatggagaaaccccatctctactaaaaatacaaaattaactgtgcctggtggcacatgcctgtagtcccaggtactctggaggctgaggcaggagaattgcttgaacctgggaggtggaggttgcggtgagctgagatcacaccattgcactttagcctgggcaacaagagtgaaactatctcaaaaaaaaaaaaccataattgtataaatttatggggaagcttgtgatgttttgatatatgtatacaatgtggaatgattaactgaagctaattaatagatcaatcacctcactcacctatcatttttatgctgaaacatttgaattttacttattttggaatatacaatcatttattatagtcatcctgctgtacaatagatctcaaaacctatttctcctgtctatctgaaacgttttaccctttgataaacagctctccatttctatcttttccctagcccttaagcctcttgtaaccatccttctactctacttccatgaattcaacaacttattctgctttcaggcatcaattttcttcttttaccatgggaaatagcaagcactgtgcttatcaaagatgtgcttaaagtttaggcttctagtgagacagaatatcagactctcaagctgaattgctggagttaaacttaggcatttgcttgaaatatcttcagtttgcattcatgcataataggtatagaattaagtgaattaataatgtcaagttattacaacaatgcctggcacatagtacattttcaataagtgttagaattctcttattttttatttatacatggtagttgtacatatttatggggtacatgtgatattttgatacatgtgtacaatgtttaatcatcaattcagggtatttagaatatccatcacctggagcatatataatttgagtttggaacatttgaaatcatttctactagctcttttgaaatttacaatatgttattgtttataatagtcattctactgtgctatcaataattagaatttccttctatctaactgtatgcttgtatccagtgaactacctctcttcatctcacctctccccatacccacatatgcccttcctagtccctggtaagtatcattctactctctacctcccttagctctcatgtatgagtgagaacatccaatatttgtctttctaggcctggtttatttcacttaacataatgacctctagctccatccatgctgtgcaaatgcaagatgtcatcctttttatggctagatagtattccattgcgtatgtacaccacatttcctttatccattcatctcttgctagacacttaggttgattccataactttgctattgtgaatagcactgcagtagacgtggggatacaggttcccctttgatatgctgaattccttttccttctataaatacctactagtgagatcgctggatcatatggtcattctatttttagtttcttgagaaatctctgtactattttccataatggatataatcatttgtattccccccaatagtgtataagagttcccttttctacacatcttcatcagcatctattttttgttgttgttattgttgttatctttttgataatggccattctaactaggtaagattatatctcattatgattatgatttgcattttcttgttaatgatgttgaatgtttttcatatacctactggccatttttttggttttcttttgataaatgtctattcagatcctttcccttttaatgtgattgttttctttttgctattaagttgtttaaattccttgtatattctggatactggtcccttgtcagattttatcccattcaacagattgtctccccactctgttaattgtttcctttactgtgcagaagcgttttagtttaatatagtcccatttgtctagttttgtttttgttgcctgtacttttgaggtcttagccataaaatatttgccttgaccaatgtccaggagtgattcccttatgtttcctttaagtggtttcatagtttcagttttacatatatttatttaatccattttggtttatttttgtgtatgataatagacgggtctagtttcatacttctgcatatggatgtccaattttcccagcaccatttgttgaagagggtgtactttctccaatgtatgttctggcacctttgttgaaagtcaattggctataaatatgttgatttatttctgggttatcaatattgttccattggtctatatgtgtgtttttataccaataccatgctgttttggttatcatagccttggaatatatttcgaagtcaggtctgtgatgtttccaactttgttcctttttctcgggtttgctttggctatccagggtcttcttttggttccatataaattttagtattccatttctgtgaaaaatgtcattggtattttgatagaaattatattgtaactgtagattgctttgggtggtataatcatttaaaaattaacttttcattcaatgagcatgaaatgtcgtccatttttttgtgtgtgttctcttcaatttctttcatcagtagatgtttttccttgtagaactcttttacctgcttggttaaatttattcccaaatattttttgtagctattataaataaatgctattgctttctttgatttattttttagctagtttgttattattgattttttgtgagttgattttatatccagcaaactgttagcaatttttgtagctatttgtcagatttggttaagattcttgttcttatttttttaatttttaaaaatattagacacaaaaattatttaagaaaaagccataacacaattgaaatattaacctctggtaagcacattcaattatgagagataaacatgtaatctcaagtaaaaatttacaccttgattaaggactccaaggtttaaatccattggaatggactttgttgctgacatttaattaacatttgtaacttttattatcttgttatatttaaataaacgtttagtttttttaattagatgcatattctataattgtttcctattgttaatcactataataggtaggtaacattgactcttaagatacaaaatatagaagaaacaacatgaatgaaatggtacctataaataaactcctttgaagataagaaatgccaataggaccaggtgcagtggctcatgcctgtaatcccagcactttgggaggccgaggcaggtggatcacttgaggtcaggagttcgagactagcctggccaacatggtgaaaccttgtctctaataaaaattaaaaattagccaggcatggtggtgtgtgcctgtaattgcagctccttgggaggctgaggcaggagaatcacttgaacctggaggtagaggttgcagtgagccgaaatcacaccactgcactccagcctgggtgacagtgagatttcatctaaaaaaaaaaaaaaaaaaaaaaaaagaaagaaagaaagaaaaaaagaaaagaaaggaatacctaaatacctatgttgtgacacctagatcttctgactcactttagctttacaaagtaagaaagtgtgttgctacttctaaaagtaataacacagtaatctgttgtcattgaagagtcatgaaaaccatgaatgtgttaagatgttttgaatgttacattttgtttggtctccaatatgtttaaaatttaacaataggtaagtggccgtctatctatgctggtataacaaagtatttgagatagagtaatatataaatgatagaagtttgtttctcacagttttagagtctggaaagtccatgattagggaaccagcaagttctgtgtctgttgagggcccactctttgcttccaagatggcaccttgaaagttgtgtactcacacagtgaaaaagagagagaagcaaaagggtctagtttgttccttccaactatatcacaaggtcactaattccattcatgagagctctgcctcatgaatcacctcctaaaggacacacctgttaatactaccacatacgggtctaaattccaacatacaaattttgaagagacacatatagcagcatcagtttattctcaatctaagaatagtcattatgtgcccttagcccgaattgtgagtagactttgtgttgtatgtggattgttgcttgtaggtgtgggccaccccagtaataggtttttgcaggtgctagtattattaaagatgagaaagtcctctagagagctcttatagttctagcagttggttccctagaagtggctgttataggtaaagtgttttatagaaccttagagataatcagataacactacaaataatgcctgctgagtatgcagtaggttagagagtatcagcactcttttaaaaatcagtttggcttctggtctctcaagcctataaaatctacttatgtagttgcaataattgtgtttttctgtataaatctctgcaaagttaaagtcattactgtttatgtttacgaccctaagcaatattccactttattttaccaaataaacttcacagtgttcacctagaaaatagctacatagtgacagtgattatttctaaatatactttagtaaaatacaggctttttctttatgcatgaagggaatcactccctgtctaattttttaaaaagctctattttcctgtgtaattaattatattgtatatagtgggcactagcatgtttttgcgtggaggaatgttatatatactgtcttaaaatgagattcatttgaaataggaattacatatcccttaattcagtaccacagcatatattcctttcaatgtggttcctaaaatttgtgaaaaggcttaaaataacaccattaacaacagtagtcaaaactattttttacatatctctgaatctctgattctcaaaattgtgctcctgctctttccagaaatgtgataatatcttctagatggtgtctttcaatccatttaatttacatagtctcttctatttgatttagattgttggtcttgccagaaaggacagtgattaccatctttgcatgtatagtacaaaaaaaattattaatatactctgtctaaaaatggaataaattttcagttgacacaacagggaaaagaaaaaaatatttttccagcccaagaggtatgacagatccttttacaaatgttaacctaccagaaagatttctcctctggtagaatctgtgattgctcctgttcggaattttgactctcaacaaaattcatcgtatgattattaaaggcaatggatttaccagtgaatgctgttgctataagattatctcaaatgataaaaagaatatattccagatgctatttgcctggtttgtggtggtcgggggcagggtagggggcggtgtggggtggggctgagagtgggagaggtgggtggggatatagttaattcaaattggcaatatcaataagaactaaaaataatagtagacatctgggtttccagtcatacattttagatggttgtaaacacatttaatgaactcagcaataattaatatctaatatgttcaaaaccatgagctaaattatatcacagggttaaaatgtgtatgacatatacacatagagtttataatatatttcatccatgcacttaataagaaaaataatatacctaatatgcataagtggagagatatacaccagaagtattttacttttttttgtataatatttccttaattaaaagccaaatccatatatttaaatttcataaatgaaaccctagtctgaagaagctactttgtggctcgtttttagagctgtataatatatttaagcactacagtttgaagcattttaaataataatatagtactgtaagaataatttatgtatgaagttcattttgaaactctttggtgacaactctattggaccaaaattgatatcaacaaaccaagcaaagttgtatttttaatatgaagaaaggataaatgaacttaaatataagcaggagacttcacacctttctccactttgctggggtgaacatccctggttatcaagtctgcattaagatatcccaatgcaagagggtatctgtctctgttcagggtggatctctcttcagctggggattctggtttcttattctgctgagaggtctagagctgatatgggtattctatcttcttattttaataccgatatttgtaaattaaaagccagccatatcagtgtgtgagtgtaatttactgtttgaatactactttctgtctcatcagcgttgaagttaataagacatacattgaatatttctgcaaaaataaaacagcctgcatagaattggccaatctctggaatctgacctctcctgagtattaaccctacagactgtctcattatttgtattgtaatggtatcaaatttgtagaagaaatttctgacataaattctcaaaaagataactggccaaacactgttacctgagtgcataaaatatacactccagttgaatcatagatccatgcagtcattctggccccaatgcaagctatcacaggatttgcttgcaaaatcaaggagtcaaagagaatatgcataaaatatggaagtcattcctgagagtatatatatgggccataacaaacaccaaagcttatataacatcataacttgattatgtatatgctggtgatacccaaaggctaggtcataatactgaaggaaagatacctgtagaatcacaactgctcctgagtacaaggtaaatatcaaccaaggctgttatatgtcatttgtgaattaaaacactctccagcaatgttgatccacaagaaactgttgagaccaacatgcttacttcaacattaaaattatatcagataaaatactagaggctgtgtcatatatccaaaggaaccagcaaatgcatctgggaaggaacttatgtaaagcactagtaatcaaagtccaaattcagcttcagagaagttatcagattgctggaaaattgcctgagaatgtggaagtattcaaaagggagatgtaaaacgtccttggataaactcaatgtacctgaaaacatttccactgaagaaaaatagtctagggcatgaatttctaacttatccatgtattctgaataataactaagctaatattttaaaattacctcttatatgccaaatactgtgcttagtaccttagtgcatctcatttaaatttcttaaaaatcatattcatagtttctatcaccatttttaaaataaagatgggaatctcaagatcagagagcctaaataactgccaaaagttactcagctaaaaagaagtagttctgagcctggaatccttgttggcataactctaatggttaaacattctaaaaaactaaggtagacttattctccgaagtttgaaaatcttctatgttatactatttatgctaacattaaaatctagtgcaaagtctaaggcctaagtggagacaacaaatgtctagtgaactaagacgtagtggtatagttatacctatagtcaaccatctccttactattatttctggagtaagatcttagcaaactttaaccttgactaagcttaaacattagcttttattagagaaaaagcatccataatttttaatttctacatttcttagaattttccaaagttttagggaaattctgctttctatagctaaggggaagggagaagtggaaactcactcatggatatcatgatagactattgcatcaataggaataagatttattttaccaatgagaaattacattctaagtcagtatttgcaataatgcattgctagatgctatcatttatgacattgcatctacagtcatagcagttgaatttaaggaatgtgtaaaaaggaactttatcttatctagacatacagtaggcattttcactgtatcatttttgtttgctgcctaatgcaactccaaacattcaagttggtaggaagaaattcaccattgcatctattgtagcacgtttatttttatcttagaagaattcaagaaatttcaggggattgattatgggatttaagacctttcactttagggccagtcttccaaagctgcatcagtaatgactgaaagttgtgcatctctgtggccagtatagtagcctacatgaaatcacttagcgatcttaactcctgagggagctgtcatgattgacagtttgaacaaagaggacaagaatagaatggacctattaactaggactgagtgaatttctcctgtgggcatgacaatgtttacctcctgcaatttagctctttgtgacagagagttttaaaatggagaaagatgttttattcagtggaggaataagagggatacagcagagtttgattccagtgaatatacaagaacagtcttcttattctttctacattgctgtcttcatatactacatcaattataaatgaatataatgatgcttttgccttgactctccagatttgctttgttcaagttcattaatgtgaactgtcataccatttattattaagtaacagaagaaggtgaatatacagttatatgtcatatactctattttacatattttagggaaatttagctggagtttgtagatttgcggatcttataatttaagaaaaatgataacagtttctgggcattctcaggatactttttaaacggccatcctctctcttaatatgaatcatataaatcacaaagtcttagcagtttgtagctattctcaacatgacataaataggtttggcagtaaataagtccctcattgtagactccttgggttctgtagtgattggtgtcttctctaagtaacttagaacactatttgaaaataatccagatcccagaggaaacaaaagaagtgaaacccttccctcactgctgtaagtgaatgagtatttcataatcacttagaccaatggcagatataccctaagtgttttgtgcttattaaatataaactaagcatttcagaattatttttgagatagttttaatggcttctagaccttcttttaaaatgagaaatctcctaaatggaaccccttttagcaatgtctacaacaggcactaaaacaaggggatgatatgaataaagaattaaagtgtcactgatttcttcttctccactttagtctgacttcccagtctcagcccagtaagggatctttccaaatgggttttgatttttacaggatgttgctgaccagtcaccaaacaatgtaatggagtcccatggtcctcggccctctgccaaatatgattcaaatagcaatcagtgacacagggttgcatctgtgcttggtgcacaaaccctgatagtgtagacatagcaccagtcacaacatcaccaatcactaaaggaagcttgtttattaattgcttcatttctcaagatccttatatcacaagtgggtactgaccttgactgatctatttcccgcagtaaaacaaaacaaaaagtctaattattgttcatttgacttttctatataactcaaaactatcttcttactaggtcatcttgatgagcggaaagttatggaagcataattgcggtcagtgtatttagacaatatgtatgatttaagctttgttttgcagaggaaaaatgcttttcagattatcacatgtgctacatttcctagaattatatcagtttggtcacattccagagaatatggagagaatatgaatgtactttaggagaatctcttgaaatgaatacttcttagtgataccaccgtatgatcttacttctttaagtctcttttatttttaaaattgatatttaacttttcttctttgtaaaaatttcatcggaatattttatgtgatcttagtgattggatacatagacattctttagataggggtccctaatccctgggctccagacaggtatcggtctgtcacctgttaagaacagggctgcacagcaggaggtgagtggccggtgaggcaccattactgcctgaactctgcctcctgtcagatcaacagtagcattagatcctcatagaagtgtgaaccctattgtgaactatgcatgtgagggatctatgttgcgtgctccttacgagaatctaactaatgcttgatgatctgaggtggaatggtttcatcctgaaaccacctcaccatctctcacccttgtcccaccacctgcatcctatggaaaaattgtcttccatgaaatcagtccctggtgccaaacagtttggggaccactggtttacacgagccctcacagaataaatatagcaacaatcacattgcctcttatggctcagagggagcttattccatttccccaaagcttcaaaacgaaaagtgggttcttactgttggataatatgaactgctgtggattgaaatatgtctcctcaaaattcatatattgaagccctaacccctaatgttatgatatttgaaggtggggcctttggtagataatttggtttagatgaggtcatgagcgtgaagatcccataataggaattgtgcccttataagaagtggaagagaggccagagctctttctctcttacatgtcagacacagtgataaggcagttatctgcaagtcagaaagagagctgtcaccagaacccaaattggctgtcagcttgatctgggacttcccaacctcaggaactgtgagaaataaatttctgttatttaagctactcagtatggcatttttaaaaatggtaatctgaacagactaatacatcaacatagaaaggagttccattggttatttgttccattggttatttattctctatttttggcctgacccagccagttgtgttgtttcatctgcatgaatgtgtttaacccccttatgaaccaaggtgatggttccttatagaatagaaccctctgccaaattacatttggatcttcagcacttcattaaatgttccccaagagatagtttaccacttattattactctttgtttacaaaatgtcagtcatttaatttatatttaacaaataattgtttaacatggaagtttattaatattccaaattctcaactaagttttaaatattgacttaccaatatccattgatttccaattttgtagttaaaataaccaataagaaattattaactttttataactatagttgtaacattatctacaattatatatttatttttgctttccaattacttaatctcaatctccagatgaaaacacctctttcttagtacctaattgttctattcaaacctagtctctcctattaagatatcttagctaacattatttgctctaacaaaaattaatgcattcccattattctacagtaatttcatttttatgttgcttacgataattttaataaattttgatgagctgttgaaggaaatactatcatttgcctaatttttaaaatatttctagattccatttagtggtattttaagctatttttatttataaaatctcttacattaatcagtttactgtgaaatttatcatgtgacctctattttcagcgggttcttaataaaatattttatatctttaatgctttatacacaaaatgatagaaaggaaattttttttttttttttttgagatggagtctcgctctgtcgcccaggctggagtgcagtggcgggatctcggctcactgcaagctccgccttccaggttcacgtcattctcctgcctcagcctcccaagtagctgggactacaggcgcccgccactacgcccggctaattttttgtatttttagtagagacggggtttcaccgttttagccgggatagtctcgatctcctgacctcgtgatccgcccgcctcggcctcccaaagtgctgggattacaggcgtgagccaccgcgcccggcctagaaaggaaaatttttataatattgtttaattcaaatatcactcactttaagagattttctctgatatttttcaactggatatgatcactttctctttcaaaagtgacaactttagtttgtatttattgcagcattttccatggtttatcttaaagtactcacttgagtaatagctctagacttcagcagattataacttttagtgtatgatccattctttcttagtcatttttgcctccctttcatcctttcctgggtttttgaatagtgtatatattaatattgctggtggactctcatgaatacttgatgtattattccattctcatgctgctaataaagacatacccgagactggttaatttataaaagaaagaagttccatggatacacagttccacataaacagggggcctcacaatcatgacagaaggctaatgaggagcaaaggcacatcttacatggtggcaggcaagaagccaaagttgcttccacattttgggtatctttacagcagcaccccactcccagtaccaatttactgtattagtccattctcgtgctgctaataaagacatacctgagactggaattgataaaggaaaggggtttaatggactcgcagttccacatggctggggaggcctcacaatcatggcggaaggtgaatgaagagcaaaggcatgacatatggcagcaggcaagagggcatgtgcagcgaaacttccctttataaaaccatcagctctcatgagacttattcacactcatgagacttattcatgagaacagcatggggaaaaaaaaacccactcccatgattcaattacctcccactgggtccctcccataatacatacagattattacaattcaaggtgagatttgggtggggacacaaggacaatccatatcacctgggtgttttttgatatttctgttgttgttttttatttttttatttttttattttttttattatactttaagttttagggtacatgtgcacattgtgcaggttagttacatatgtatacatgtgccatgctggtgtgctgcacccactaactcatcatctagcattaggtatatctcccaatgctatccctcccccctccccccaccccaccacagtccccagagtgtgatattccccttcctgtgtccatgtgatctcattgttcaattcccacctgtgagttagaatatgcggtgtttggttttttgttcttgcgatagtttactgagaatgatgctttccaatttcatccatgtccctacaaaggacatgaactcatcattttttatggctgcatagtattccatgttgtatatgtgccacattttcttaatccagtctatcattgttggacatttgggttggttctaagtctttgctattgtgaataatgctgcaataaacatacatgtgcatgtgtctttatagcagcatgatttatagttctttgggtatatacccagtaatgggatggctgggtcaaatggtatttctagttctagatccctgaggaatcgccacactgacttccacaatggttgaactagtttacagtcccaccaacagtgtaaaagtgttccagagtgaacaggcaacctacaaaatgggagaaaatttttgcaacctactcatctgacaaagggctaatatccagaatctacaatgaactcaaacagatttacaagaaaaaaacaaacaaccccatcaaaaagtgggcgaaggacatgaacagacatttctcaaaagaagacatttatgcagccaaaaaacacatgaaaaaatgctcatcatccctggccatcagagaaatgcaaatcaaaaccacaaagagataccatctcacaccagttagaatggcaatcattaaaaagtcaggaaacaacaggtgctggagaggatgtggagaaataggaacacttttacactgttttttattttttatacaatgtaagtgtcttagtgactctatcatttagatggaaattcaagaccactaaatcagcagaatggtagagtttactagctggtgattttgtctgctccaaaaaaatattttatctaaagcacatttttgagctgcctttaatttataataaatgtatcatatatggatccaaaggtaaaaatctctctcaaatagaaattaaaaggctttatttattctgatcacatttctttataattttacagagcatttaccacctcagcctgatatttccggaatgaacccttaatcttttaaattagttatcatatgacagatacttgaactttttattcttctgaaatacagctacactattgtatctttcctaagttttcaggaccaaaaacagccgttctctaggtttgaatgaaacataaatagctagatgtatttctgatttacttttatcctatatgtctagaaggcaagatccctgttagcctttcggggtagagcaattcattaaaatacggcctcaattttaactaagtaaaattaaaaatacagtgtcttaatcatactagccagatttgaagggttcaaaagtcacatgtggttattgactaactttttggatagtatagatatcaaatgtttccaccatcatagaaaattctttggaacaacagcaacagtagtttacagtttatcttttattttacaggagttttcatagatagacactttacatgagctccatccaaacttctaaattaaaaacagacagtttgtttgcactgaaaaattcattttcccttgtcatttgttttttagttgtaacatttctttgactgttatacaccatttttgtgtcaaaatatagatattttttccaatgcctgacagctctctattttttctttttatcacttgtttttagtaattttattatgatgtgtctggtgtggttatatacatatttattctgcttgaggttcattgagattcttagatctgtgggattatcatttttatcaaatttggaatattttggccattaattttcttgaatatttttctactagctccttggagactccagatttatatatgtttaacggcttgacagagttaaatattaactcactgaggctctgtatattttttcaatgttttatccctatactacattttacatattctctatttctacaacttcaaattcacaaattcgttcttctgcagtttcatcaccattcagtgatttaaaaaaaagttttagatattacagtttttatctttaaaagtcccatttgattcattttttaacatctttaatgtctcttctggtcatgggtcatatttcaattcttaagatctgtaggagtttttgtgtgatggtgaaaatagtgtattttatgtgattgaatgacttctattttctcttttcttttttcttttttttttttttttttttttgagacagagcctcactttgtcactagaatgcagtggggcactttctgctcactgcaacctctgactcccaacttcaagcaattcttctgcctcagccttccgagtagctgggatttacaggtgtgcaccaccacacttggctaatttttttgtatttttagtggagatggggtttcaccatgttggccaggctagtctcaaactcctgacctcaagccatctgcccacctcagcctcccaaagtgcagggattacaggcgtgaactaccacacctggcccaattattgtttttaaagaagtgttatacttttctttgacagacatttgggttgtttctggtttagttggatcatcttaagccttgttttcaacttttgctagggtggtcacagaatacctttacctattggaatctttaatctccattactaaggctcacccttctgatgcctaaatttaattctccaggtagtcaatttggactctgcactgctgctggtaggaacttgaatgattcttggccttctgcagttcttggaatcattcagttcacaagtttgcaataacttcttgcccagcctcgtgaaattatagcgtttgcatacatgacttagaaatcagcataggttcaaaggactttaaagcagatttctagagttctttgtctgcatagctctcttgtctcaagaaacctgtcacacaaattccaactgccccagatgctctgaactctgatctgtatctcctcaactcagtagggtcactgtctcagtttgcaatatcttccccactccacggacactgctctagacctgaaatatgttttacaggcagaaagcttggctgtcctatgttttactttccttgtctcttctttctcagatgtaatggctctgtactgcctgtagtttaatgtcttaaaaacagttgcttcatctatatttccctggttttctatttctttgagtcaggagggttaatttagtcactgttactccatcgtggctgaaagtggaagtctttcttcaactgatgtaaaagtttatgtaatagaaaagatattaaactatgaattgaggcctaacttttagagaatgttgaaatgacagaatacaatactacaacaaaacttactcttataaacactgatagaaactgacaagtcggtggttgtgaagaaaattagatatatagatatgtatagattttaaggtaagtaagagttattaattagaattacacagttgtcagtttggaggtacaggtatgagtgtcatctacacagaataaaagaacagagcagagtccaagatagcatgttgacattcacagtgaggattcagagtacagctgtaccctcgaattaaatttgaccaagggttatcaatggcagaccaccgggctctgtaaaccacaggtctgatctaatctagcaattcttgtgtttgcattttaaccaatgtatatctgtccaggaaataaaatgtcaactataagaattgtttacccttgaaaataactctatggtgtttctaaaaatatatgtcacatgagatcacaaacaaagtagtatgctttctgtggattgtattactggtgttggcttggaatggtaagaaaggaaactgactctaaattacctatcttgatttttcttgtttcattaattctcagagcatttgtcttgagatatacaatatctcaaattgcaagataaaaaaatatatatcaacttttctttcttcaactctactttgaataattcataaaggaaccacttaaaggtagctaatctgaatcaatacaaggcagtgttataatctttgtttctaatggtgttttactcttaatttttatgtaaataactgaatgtattgtttattaaactgatcttcattataaggagatatttataatgttggctgtccaatatgaagtaaagctttaaaaatcccagatgtaatattgaacaacttaatttgaaacattttatgctacttggttgctcttgatttcaggagtatctgttttaaatgcataataagtacattttcaagcatatccaatttacatgccttaaagacttccaccgccttaatgcttaatttagaaatatcattttaaatgattcttaaaaatcagatgcacttatttttgtagctgtaatattttaagagagccttcatataaaaatatagttgtcactgacaaactgtatcaattagctaatgttcaacaatgatcatcaatgtcagggactgttaccttgttgaaattttagtttagccttaatggtgtctataaattaataggtactgtaaatgatgcatgacaaaaaatgggttgttagcaaatgttgtggaaggaagaaaggaaggaaagaagggaaggaaggaaggaaggaattttcaaggccttaagaataaatctatatgtgctggaatacttagaaataaaagttttgtttaatttaattaaacacagatattctaccaagctcacaaaatgatttttaaaaatactagcaatcattaggcaacataggagcctttagttaagtgaattagaaagtgaagttaagaataaaatttcaacagttacctaatctactaatttgctgatcattgatgaacactggctcttatgttttgttttgttttgtgtttttatgaagctgacatgtactattggttcaaataaatagcatatatagtattctggctaagtcgcttatttttaaaattgtggttttcttatgttaaatttttgaattgaatttctaataccatttttccttttccacagcctttaatggaacaaattgttagtttctgacagaagggttctgatgttgaaatagacagtatgtctacctattacagaaatatagaaataaaaatgcatgtactcaaacagaagatggaggttacatttctttattacatctatcatcagaccttagccatgttggatttttggttgctgttgatagaataaggcagattttcctcaaactttcttttgcaaaatagttagacttaaatataaaaacaactgcaaaatattcagtcattaacaaatcaagaatctttataactgaatgttaagtgattatgttttttctactgtatttagcaatgcaatacttaccttttatattactaaatatattaattttattctcaagaaaatcattaatacttagggattggaggtttcctgagtgtaatattgaaaaactgttaaaaagccactgatacccattcgatctaatgatttaccttttgattatttgttttgtttgtttgtttgtttgtttaaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttggtaagtcatgctcagacatggatctcacgttattgttcatatatctggaaattgttttatttcacaaaacccaacaccactgttgtttctacctcttctttaaccaattagagtgattttatatttattatttatattttttcatcctcatattgttttgtatataggtatcttattttctgtacaaatttataaatttgagatcaaggctactttgcaatacttattacctccacccatcctaacacagccaggcaaataataaatatgcatcaggtttaactttatttgacttgagatagcatctgtcttccaggaaacactatcctatgcaaaaaataacttcacttgtcatacttatagcatttgatctgagcctaatgcattttcctcatttcctatgttttggaggagaaggggtagaaaatagcgaaagaaagtaaatttttagaatggggaaaggaatataattcacattttaaaaatctagttaaggattttgtgtattatacctgtataatcatgcataataatcagatttctgtctaatgttcaagaaataatatagtttttttcaaagaaaggaaaacaatgcagtctgaaataaaaagacttggaaaaatattttataattaatgtgtagataaaaatcaaaattagataattatttagatgtttttctaccttaggaaaaaaatatggttaatatattaatgattcctcaatttatgtttcttgttctgtctagattaatatatcaaactcattgtacagcatcttctcatggatactcaaaaggcatttcagcttcatatgcccagaacaaaacccatgattttccataccctcaaccttctccactcccaaatttcctcatcacaataaagggaacccccaatttatccagtttaaaaaaaaaaaaaaactttgattcttaacttcccccatcatcaagttcgcttgtcaatatattacaaatatagtccaaacccaatctccttttaaatgtgtgctgaaggccatctcatacagcccatggttgtatctcaggggcactgaaataactccctagttggtccgcttctttttactcttgccagagtgtcttttaaaaacattgatcagattatgttcttaacctgcttttaaacctctaatgcctttctcatacagaataagattcacattctataccatacctacaatgccctatactgccacatcttcaattctatctccttattctctctcccttcttgaaccactctagtaatgctggctgccttgataatgcctcaagcattccaagattgttcctacttcagaggctttgtatttgctattccctctgctcagacaacaggtctttgctaattatttgctcctttctttagagtgtgctgtgctaaaaatttacctccagtgagaggcctttactgaccagcctatctaaaatagaatagtcatcttcctccttctttcactgtctattctattactgtgtgttaatttttttcatagcacctatcagaatctggattacatagttcaatttataatcttacctgtgtcatgaccacaaatataaagatgaagaagcatacaaaagaagcaagttaaaagtatagagaaatcaagctaggagagtgttaagaatattgtgaatattatcaaatgatataacacaattaaaactatttgggaaggtatgaattcattaaaatgtaggagaagtcagagggaatagtcttgagggaaaaaagcaaaagatgttttgggtaagtgcctgatatttaactgcaaacaaatcactatcagataggaatatagtttttatttacattggtcccatcgaactttctatattttaaagaaaggaaagaaaggaagtgctttccaacagacattggtatattttccacttgtctttttgttttccttaatgtctccattctgcttgcttactttgatatgggaattttctgacatttgtgttttcctttttaagttgaaagtcttaattcagggccatatcccagcagatttcagggcaagctctatttactgtctgtatcctgattgttatgaaactaacaaatacttgaggaaatgcatttaattatttttgttgtttgaaaaattaattatcagtttaagatcaattaaaagcctgattcactttttaatgagctacagctaattttctggagttctgtttcctatcactactcagttgattgctgtctttttgagaagaatgcaatgggcaaagataaataccacactaaaaatgtagtgccttacatgcacaaacccaaggaaaaaaatgatgacaccaaattgctttgctttgagaggcacaaagttaaattgtacctcttctaagataccatttctcattctcagtcattcctcttagatcctctcttagttttgtcctcaggtaaatctttagagcatatatcctaatcatctataatcacactttgtgcctgaaaccaagtcttagactttatttctttagttcaaatctcgtctttcactacctctgtccaagctgaatgacttcatacaaagcaagtacattaaaatttatctaacaactttgcttttcaggtcaagtgcttgaatatacccagcggtttttttgtttgtttgtttgttttttactatgttgctagaaactcaggcaaagacatgacttccaattgttccctatagaagttagttcatccatcaggtcccgaagaagaccctcagtttgtaggatgtatatacatttctagctttaagtattatacctttgtttttgatgatttgagcaaaacttaggttcaagtatattaatcacttgcttcttgagttttttgattcccaagtaaactctttctaatctgccctccaacaaaccccggccagttcttaatatgaagtgcatttttatggatgaaataataggctattattatatgaagttattattagtgtcaggtaccacgacctatctaagcattctcctttctcttaagagtgagaaggaaattaatattgattagatcatgcactgcattagtactttacctttattaccttatttgatctcaaataatgcatatttgtacatcattttctgaaaaggaacaatcttttatttactgcatgtttaaaatatttatatatgatttagagattaaaaattaaacatcagtagtaccaggaaaaattaaacactctaatgtcagttcttaaagttttatgaagactatagataacttggccataatttaatttactttcttatacatttccagttgtttggcacgtctttcgcaccatgatagagggtatccatgtttattcttagcttctgtctttgatatataatagaagactgctaaaacctctgtggaaaaacaaaaaagattgcattttgactcatattacttagggattcctaaaatgtcagaatctatctatgaaattattcattattcagaatttttttaaatcacaattcctataatgtaaaaatcctcataaaactttacgtctatatttggttatttaattgattttaatacaatttaaatataagcaggtgaaatttaacatatcctcttaatatttaattgagtttgaattctaagtttgttaatattggaaatatttattgcatttttcaatctaagtgtagtcattagaacttttttcctcaaacacattatatgcgagataaaaacattttaaatgcttaatagagacaatttttatgagtagtcacatacgaagtgtccttttacacaaaatgttatgcagaggttagagactaagactagacagtgccaattttatgtatctattgattacattggcttgattacagacatgctataaataaacatttgcaatgtctttctttatattcggattattttactgttacaatgcttgtaaaagatacaatttatgaacttgagaagccagctgtggatagtaggaggaaccaaacactgaaaaataatttatctagagcaatcatttttgttctgaaacccatatgcaggcccctgtccttaagaagcaaagtgtgctttaggaaaagaatatataaagcagagaattaaattaattgtatcacattgtaagtgtcttgcaaatgcagaaagaattcaaagtgggaacatgatgaatagggatggtaaattttaaagtaaatatggtgaatatacttaactagatcctgaaggaagtaatggaattgtcttagtagagaggaagatgtttgagagagatataagaacaaagaagagaacattcaaatgcttgtaacaattcccgtcaagcatgtgctgagagcaatggatttcaaatgtcttttcatccccaactgttttgcatccagagtgatcttttcaaaatgcaaatctaatcatgtcactgtcttttaaaactttcagggatttctcattgttctcagaaaaaagaatgaaacctttgctgtgggctacaagtttctacctcatttgtttctttgtcacctgcagactcacatcatagccccatcagccttgcttagagctacaactacattcacttctttcagttctttgaacaacttgtgttctatcgcccaacagggcctgtgcacatgctatcttgactgctcagaaagttcttccctatgaagctctgcaccacctcaccctacttccccacttaatcccttttgcctggctaatcattcttcagatctcaaatgaaatttcagtactttagtgaaacctacttgtgtccctcaaagctagctggagtgttttacttcactttctagcaagtatcttcttttcaattgtatttttatatttattattttgtaattgatatctgtcccttctccctctaagctataagttttttagggcacggaatatatatgtttttactcatcttcttagcacctaacaaaatgctaacacttccatggcaaatgctcagtgaggatgtactggatgaatgattggatagatggttagtaggaggaatggatggacttggctaaaggggtccctcacatggaaaagagcaccacaggaagaagacaaagaagcaggaggaggagaaataagaagagaacagggagaagaaggaaggagaagtggcaattacaagttccccagaaagtgaggcgatatagttggggttgctgctaagcgaaggcaaagtgatcatgatcagcttgctaaggagactaggtatttaatcttgaaattcttcaacagacattccaaaggtaactgtttcgtaggcctgatttcagttttttataaatataatccaatctttaataagcatgaaatattaacacatatatactttattcaaaagttagagtgaaggatatattggtttgaagaaagatttctattcatgaaaaacttcctacacattccttaaaatgtcatcctttcatagttttctcttattaatagctggatatttgcatggcacttcatcattgtcaaagttctttcatgcacatattatcttctttgattttcacaacaatgccaataaataatattagtatttacgcccattctgctggttaggagccaaagcacagagaaatgaacttagtctatatcacacaaatggtggtgcaagattgttggctcacattttctgaccgtaattatttttactatttctctttccagaaatttattccatttcagcagagtgatcatcaactctgtcatccaaacagtaatacttttgagagtaaaaagttactctcattgattttgctttgtttgtggagcctgtcctgtgcatggtaggatgttagtagcatccctgcctttttttttttttttgagacggagtctcgctctgtcgcccaggctggagtgcagtggcgctgtctcggctcactgcaagctccgcctcctgggttcacgccattctcctgcctcagcctcctgagtagctggagctacaggtgcctgccaccacgcccggctaattattttattttattttattttattttattttattttattttttgtatttttagtagagatgggtttttcaccgtgttagccaggacggtcttgatctcctggcctcgtgatccgcccacctcggcctcccaaagtgctggattacaggcgtgagccaccgcgcccggccgcatccctgacttctacctgcaagatacctatagtaccccttccaaatagtgacagccaaaaattgtctccatgttaccaaatgtctcctgggaggcaaaatcactccagttaagaattactgttgtagggtaatcataccaaaataaactccattaattttcagaattgttctaatggtcttaggataaactatattaaaacaatgctttgaattattttgacagtaactcataatttataataagaatgtatcttttccaattgttcaggaaataaaactcagtaagtgcgtttcagggcaattttaatgtattcatgaccatagcttacccacttatatcaccagtttgttacaaagccttctgtctcttcacatctttaatacactgacttttagaggtgtgatttttctccgttagatccctccattcaaacatgtctaatcgccactagaaatgatgaagaaaaagaaagtatcatggaagagttaagtgaaaaatacggagtaccaagattactcagaggctcaggacgatcttcaaatatatattattcaacaacaacactaaaaacttgttaagacaaatacagaattgtagtatccctagttgatgttgtctctaacaaatacattagttttaccaagcatccatcctatttcactttggtaagtattattcttctgcatatgcctccagcttcaaattagatggagtatctgagcatctagcaaggacagattgacagacagcctggggtgaaatgagtatggataatcatttttgacaaagtagtctatcacagaacccctaaagaagcacatgaaccttatggagatttctaagtcatgaaaaatcttgtagaaaacatccaaagaatgctgcaggtaataaatagcactttcagcaatgcaccattatgtaattctattaccatttggactgagaaaaaagaagataatttttagcttttgcctcagtgtctaaagaagatattgttatcataatttcttaacttgataggttaacaaaacttccactctcgaagatacaaatcaaaagttagtgcttcagctactttaaatattcgctgcaataagcatacaaaaatatttgaatatgtaaatcttggaatttttcttaacaacctttgaaactattcatcattctagctttttccactaactaaacgttcaactcattcctatattttaaacatccaattttcctaccatattttatgttatacagattatgcaaagtagttcatcaattgcagaatgctatgtagagatggctactatatttgttttaaaaactctattcagggtgtatacgtgcacatgtaccctagaacttaaagtataataaataaatatatatattaaaaaaaaaaaaaaaaactctattcacgggccgggcgcagtggctcacacctataatctcagcactttgagaggccgagacaagctgatcgcttgagcccagcagtttcagacctgcttgggcaacatggcaaaaccccatctctgcaaaaaatacaaaaattagctgggcttggtggcatgcacctgtgatcttagctattcaggaagctgaggtgggagaatcacctgagcccgggaaattgaggtagcgggctacagtgagctgtgatcatgccactgcactccagcctcagtgaaagtgaaatcctgtctcaaaaaaaaaaaaaaaaagtctgttcacaaggctgtggagggacttaaatggtatacaaatgagtgggagtgtgaaaaattacttacgagatggtattcagtacaaatcacttttgtttcatcttttctgagattcatagaaatatattgccatcctgtatcagtggcttgtagtaatgttttttatttatatatcattttttcctcatcaaccttctcaaagaagatcaaggtacacttcattacatttttaaaaaattatctttccagcatccttcaaggaagttagatagtagatttaattaaactcattttacaaataaggggaattctataatgtacttaaagagagcaggttttatgaaaacaaaaatctcagaaatttcttccaatattgtgcataattactgtaagtttccttaattctacttccaaggtttgtatgtatgtatgtataaatctggtaattgtttaagaagtcttcatcctcatctttcactgtcatcaattaataagtaataaaaacaatactatgtgggttataaagcacaacagacatttaaagttttcagtaattaaacagagctacttaaaatgctgtaaacaaatgctaattagcaagcctccacgatagagtgaattgtagaactaacggtctgtcagccagggagatacatggccccacatatgatagaaagcccgggggatttgctttctatttctaaaattgcttatttgactcaatcactgaacctaaattagcgaaagcagtggtagagactgtaaataatttttttcattaaaactatcattggaaacttctgagcaacatttaaagattgtattagttctaacttgcttgttgttacttaattcctactacaaagctaaataatatataaaataaatagaaaaaatcagtgtctcaagttatcctttaatgtggggaataaaatgtctgaaagtcatttatgaactaattttagaatgctctactactggaaatatttattctttcaacactacatttgttgttttagatgcttgccaacatatatgttaaattctaaaagagaataaaaacatagtgcctccaccaaaatgaaataacataaaatataaagtaaaataataaaacaaaatagattacagctcttggaaaatattctaattgtggagtaaaatatttatacataagataacatgcagatgaagatgataaatacaagataaagcatgatgtaatacagatcaaataccataaaaggatgaagtattgtaaatttatttaagaaaggcttatgcgccagttgtggagtaaaatgttcacctataaaacaacacacaataggaagtgggaaactcaaggcattacgtaacacacatcaagtgctaccggaattttaaataaaaagtattataaggttgtttggaaatgtggattataataaggcctgttaggaaatgtggatttgaatttaactgttactctaaaatatgtggcaaacaaattgagtataatcatgaagaaaatctttataggctgcaattcttaagtaattttaattggaaccaaaacacagaattgaaatatagcttgcaatgtttgtgaaagttggtggtttcgagttaggctcaggactcacgattcctatgttagaatcctagctctccacttaggacatgtggaactttggacaagttactaaaggagcagctgctgttgtcttgtctgtaaaatgtaggtatcagaatagggcccacctcatagagttgtgaagattaaatgcatcaatatgtgtaaaatggttaaaaacatttcctgggacatacaaagtgatgtaaaaacctaaaagaaggcaaaagggctagatatccaattaagtcctactgtttaatgccttctaaaaatgaatttagaaaactggagaaacaggtcctagatctttagctttttgaaggtgttggtcgtgttacaagaatttatgttctctggctctaattttctcatttgtgaggaagccatgggactaggtgatcagtaagatcccaaaaaagaccaaatagtcatgatggtttctgctttttctgtcttgttgaaaaaaatctttgcctcttctttggccataaagacatgcttctgtgtttccttgtaagggacttttgtattggttttactattcacatttagactttactacctctggaattgaattttttggtatggtatttgatagtgaaaaagattcactcatttccatgtgaatatcaagtaatcccacaggatttgttgaagagactcttgttttttaactgccctgaaatgtctctctgaatatatattaagtgatcaagtatacatatatatatatatatatatgtatatatatatatatatatatatgtatatatatgtgtgtgtgtgtgtgtgtgtgtacatgcacagacatacacacacacacacatgcacattttaatttacatgtaattaaacgtatgctgcaaatatgatattgtaaataatactgataaatactgtaaatgacaccattttggacatatttcctaattgtttattcccggtctatttattgatgtatttatgaccttctaaaatcacgtattaattttaagcttactctagatttttaaaccagtgtatgtgtacaacaatgtctcttgcaaaaaattgagttttatttattatcttccaatacgtactcatttctttccttgcttattctagaataatattgaagagcaatcatgatggtaggtagctttgtctcattacgtgagaaacctgttaatattttgttattattgtttatcataggatttgtgtgtgtgtgtgtgtgtgtgtgtatgtgtaaactttctattaaattaaggaagttatcttctatttctagttggctaacaacttttaccaggaaatcatgatgaattttatcaagtatatttcatgcacgcattcaaatgaatttttattttcccttttattctgttagtgtgatgaactacaacaattgatctttgattgtgaaatcagtctcatacttctggaatcaacccatcatgataaaaaaaagtgttgtcttgtgtgtttttttttaacctctatgttcatgataaactattggcttataatattttttctggttatgtccatgccatttgtactgtcgaggagatgctggcctcatagaacaaactaggaagcattcctacttttcctgttatctggaagaatctgcatgtgattggtaacatttcataacatttggataatccatcaatgatgccaattgggtctggaatattttgtggaactatctttaatacagatctaattgccttcattgaaaagtactattgagatttttaaaatattttcttgtgtcagttatggaaaaatgagttttcaaaaaaaagtgtacatttgatacacattatcaaatatattagcataagattaagaactttaagctatgtctttttgtttttttaatcagaatagtgataatttttcccttacctctttcattttaagtcagattagtcatctattcaaacacccaaattatggctttgtgtattttctctatggcatgtttgtttttgcttcattactctggaataatatccttttttttttcttctacactttgtgggtttaatttgccactcttttcctaacttcatgaatgaagacatagatcattgatttttagcttctcatgttttctaaaacagcatataagtctgtaattctctctgagcacagtctcagcctcatcccacatgttctagtatgtcatattttcagaatcatttagttgataaatattttctagttcatgtctatatttcttctttgaccatgggttattgagaggtttgttactgacattataattttaaaaattgattttagcttaatttcactgtaaccagaaaataatatataataaaattaattaaaattcaatgagaacttttaaatagccctagatatggtcagttttagttagtgttctatatgcagttgacacacagtacatatattctattgttgttctgggtatccttctttatatgtcaaacaggcaaaaatcgctaactgaattactctgaccttccgcatcgttactgatttttgtcctcttttccatcagttattaatagatgtgaattacgattatggatctttctgtttatcttcttagttctttattttgttttatatatttgaagcaatatttagtaaatacaaacttggaattggtgtatcttcctaatgtagtcatcctttcatatagtatgatatatctatatctttagtaattatttctgtcttagagaaaagcttggtttaatcttaatattccttaactcacttcctcttgatttgtgtttgtatggtatatcatttttcatccgttttaatttcagtgatcctgtgtcttaatatttaaagtgttcttgcaaggaacatagaatcttccaaatacagtaggacaacctttgtttttttaattctaataacctattcacatttaattgcggttatatttgaatttgtgtctacaagtttgctgttttttaaatttgttccatgtactgcatgttcatttgtggccatttttagattaatgtttcttttattgttttgccgtttccactctgttagctcctaagttctgtatactttactgtatacatctcagcttataccattttactttttttatacatcatccgtttcctcctcagtacctggattgttttgaagtaaattccaaatctcagattacatcatttaatctgcaaatatttcagcatgcatgtgtgtatatgtataatatatgtttcagcatatatgtatatatgtaaatacatacattataatttcttaaataaccacaatattattatctgatacggtttggctgtgcccccacccaaatctcatcttgaattgtagttctcataatccccatgtattgtgagggggaccatttgggaagtaattgaatcatggggggcagttaccctcattatgttctcacaagaactgatggtttcataaggggcttttcccccttttgcttgccacatcttgctgccaccatgtgaggaaggctgtgtttgcttttccttctgccatgattgtaagtttcctgaggcttccccagccctgaggaactgtgaatgaattaaacatctttcctttattaattacccagtcttggatatttcttcatagcagcatgagaatggactaatacattatctcactgaatataattgctgtaatcccttagtgtaaatctagtaacaatcgtgttttcacagttccctctcataatcatttaattaatttgtttgaattgaaattcataaaagatacagagattgagattcattgacacgtcccttaagtctcttagtttaaaagctctcctaatatatcccacatccccttgtattttatgttgaaatacattttgactccattgaaagaacaaaatcatttgtcctatataattgtacaggtctacagtttgattattgcatccttctggtatcatttaacttgcttctctgtgtttcttgtacttcctggaaattattaattatatctagaggcttgattagattcaggtggaattttttaaagatttattcctggtgactgtgaacttccatcagaaggtacatgtctgattttctctccttttttggtgctaacagccagtgaatataaaattcactcctgtcttttttattgtttttttttgctggaattattctaaaaagagaaatatttttcattacatatttgattaccatgaattatgattgtatagaaaaataaagtaacttactatttcccctttatagtagtattcaaaatagtaaagtggtggtgtatcactttacaaaatctcacaaatcaccactaaagaacttatttatgtaaccaaataccatctgttccccaaaaatctatggaaataaaaaaaataaaaaaaaacaacttagtaaagtggtttcctagtattttctaaagactaaaaatgagttttaaaatattcttaataattttatgagctcagggattaaacatagtagatatatttcagtaccttgccattatctcaattaatggtcaaattattatgactttggctttgacaccatatttatgttggtttctgggtcgttttgacataactctaagagtctttgatagtttcctttatttctgatatgacaaaatgtttctgagtcataatttcctgccccatgttgggaatcaaccagttctctaaaatactctggtatcatttattggggaatactatttagatccaatattctgggtgctaagaaagctcattaacctcatcaatcttacagtgacatcgatcagcattgtcagaaatatcacttctcaatgacactattatgactgctcatttgctttatcccacaatacacctataagtctcagaaaaacagtaccaccagcaccaacatcattatgatatctgaaaagagtttaataattttttatttgagggctgcagaatattccagagaatattctgttaggtaagaacaacaaaattattatgttttaaagtcacttggagtggttctcctctgtgaggttatgtcaccaagtaaatacacagttttaatgtttgattattatacttgcttttctttaattttttacaaccatatatgatacttacacgattccaaaatcaaattaaaaatatatatattcaaagaaatttagctttttttccctctgctatcctctctctcttcccacttgtaaacttttatttttttaaaaatctaatctatttttctatctacatactctccattttagataaatcatgatgtgttaaacatacttttatccatgtcagattttttatttgtcttttcttgtaaaaatttcatatcttttggagatactctctttttatcattgcatagtattctattgtgtagatgctccatgtgccatagtttattaaaccagactactgaggtgatgactgaccttcaaatgtttccagtcttttcttatcattagttacactgcagaaaataacctgatgagtatgctctttcatattttacatagggtacactgagatagattccaagaaatgagtgtgggatcaaatagtaagaacatattacattttgccagatattttcaactatctatcatattattcaacttcacattttatcatgcaatgtttgacagcatctgttttccatatattccatatatccatatatttggaatatattttacaacacaaaatatatttgtaaaacttgaatttttccccatctgatggatgatgataagtagtatctcatatagttttaatttgtatttctcttattataagtgaaatcagttgtatttttcttatacattaagaaaataattaaattcattaaccttttcactgttgctccttgaatcatatttctgaaaaaaattcccacttctaacatctataaaaacttgcctttttttctcctcatgcagtttatgtctcttatccatgtggaatttacactgatatgcaatataagaaattgatcaattttttaccatatccatacagttatccagctacaccatcatcacttattttataatccatcttttcctctatagtttaaaatcctgcctgtgtggtatttaaaatttccgtaagcaaccagttctatttttggatttgcttttctgttccattggtctgtctgaactaaaacctgtcaatactaaatgattttcattggagaagagtagttttatcatctggctggacagtcctactccatgctgttctctttcaaaactgtcctctctgtacctactagatttttctttcaaataaaatttttattcaaaatttttagatacagaacaatattatattctaattgggcttgctttaaatttgtaaataaacataaagggttgacaactttgtgatattggaactctgcaactaagtacataatatgtatttccatttgtccagatctacttttgtgtcttttggaagtgttttatggtttacttcatgtatgatcctcatgtatatttattatgtttctgttttaatacattcttttaaatttgttagcataaatagagtattttctcacattatatctttttttctttatatcttacaactgattttgttttcatatatgaatgctactgagctttgggggagtaatattataatgacatactttacaagttgtctctttcttaagtggtcctgttgatattttctgcttctcaaactatatagtcatatctacaagtaaagatatcttacattttattatcaaattattatgtttttccttgtcaaactgtattaactgatagctccaaaaggactttggtattagtaacagtgatgaacattcttgtgttgctcctgattttgcagtaaattttctaacatttccacattaaaattctgactttgggactgagtttatgtgtgtgtactgtatgtgagaaggaggaagtggcagggcgggatgagacagtggagagagacagaaagagagaagagaaaaagatatatatttttttttgacaaggtctctgttgcccaggctggagtacagtggcgcaatctcggcttactgcagcctcaacttcccgggctcaagtgattctactacctcagcctctggtgtgactacaggcacatgccaccatgcccagcgaatttttgtatttttagtagaggtagggttttgctatgttgcccatgctggtctcaaactgctaggctcaactgatctgcctaacctcagcctctcaagatgttggaattacaggtgtgagccaccacgccgagccaagagagaaatcttaatgtaaatatgtacttatgtactgaattttgtcaaacgtctttttagcatcatggagatgaccatctgacttttctccacaactctaccaatgagatagatgactgtgaattaatgaatttcttaataataaatgccacttggctgtgatgtatttgttattatgttgctgaattctgttagataaattttacaatttttgtttataagtgagttgattagttgtttacttttttggagaaatcttatactctggcacaatatgaattcctaacatttcttattttactatgcttgggttatctgatctttaaagaatttgataggattcccctggataaccaagtgtatctagggattttaggggtgggtagggctcttgaatgactttatttcttcagtaataattgtgctttcttactctcctttcccagttattttggttaggatagatagtgctttgtctattttgttggagttttcaaataataagctattagatttacatcttagttctaattttaatttttttaattttaccttaagttctgggatacatgtgcagaacgtgcaggtttgttccaaaggtatacatgtgccatggtgggttgctgcacccattaacctgtcatctaggttttaagccctgcatgcattaggtatttatcctaatgctctccctcctcttgccctcccaacaggccccagtgtgtgatattcccctccctgtgttctcattgttcagctcccacttatttttaaacatttttttccatctttttaagtgggtgttactttttattcttaatttttattttcaaattaacataggtatttagcgttatttctggcacttgatatgctatatttttctaaaattctgtagttttagtaattcttttatccaaggactgttgttattttttttctttctttttacttatttttttaatttttttttgagacggagtctcgctctgtggccaggctggagtgcagtgatgcgatctcagctcactgcaacctctgcctcccgggttcaagtgatgattctcctacctcagcctcccgaggagctgggactacaagtacctgctaccacgcccgtctaatcgtttgtatttttagtagagacagggtttcatcatgttggccaggatggtctcgaactcctgaccttgtgatctgcccacctcagtctcccaaagtgctgggattacaggcatgagccactgtactcagccaagttttttccttttatctctaggaagaccttttcattgtcattaatttattgtattattgaagttttctttgtgggataatatgccacaatttggtaaacattcatatgataaaagttgatatcatttttgagagttgagttctctggtaaatgtttaccatgggtccttacccaggtttccagtggttttcattgtctgaagcttgacttttagtatattccccagaaaggctaatgggaataatattccctgagttgttgcttttatcctcaaagttgtagcctttatccttgaaggtcacttttacttgttagctgttctcggtcaatttctccaggttaaaaatgtgttcccttagtatatattttcaaattagattttttttcaggaatgtgttctcaacttataatttatggtagctaatttatatcgtttaacatttctttgctaacttctacgtttatcactttttctcaaatcctttttatctttttttaaagtttatttttgatctttaaaatttacttcctttccatctcgtatttttcttaagtatgattttctgtgtttgtttgttcacatgtctcttctagcataggctttctttatgaaattattttctgtaattttcaaatatttcgagttctgtcgcatgtttacagatacctttttctccactcatgtcattgtagggactttcttattctaattgctatacttatttaatagttactaccatttccttaaaagttttagcacatgttgaaattatgtgttataattttgtttttttgtggccatgtatttccagtgtgcttttgtcatctgtatggatgtatttccagttcttgtttactttcattttctcttaaaacctatttggagacttgaatgtgatctattcctgttgtacatcttaaaaggaaattcacttttcaatgttttcagaagggataaagtaaggcagaatagattttctagctttaaatcattagaattctcacttttgttgttttcaaaagtgattttaaaatatgtccttttagaacttgagttctctttactgctctttcttcctcaattttatttgagccattttttctctttttcttttttctttttggacctaatttgctttctgttcaacttggaatttattctatgcaatttcttttcactgtgatgtttcgctttgcttggaaggaaattactggttgttaattgagagtttaaaaagtcaaaacctctctagaatgaagaactttcctcaaaatacagaccctttttatgtactcgcaaattggatcatgagagccctctgcaagttttggatgctgtttccatatggatctactacatccaaagggagtagctgtttgaactgtcctgttctcagagaggcccagttatttttattcctctttctcccacacagatacagctatgctatgtagaccttgcagcgggtaataatttctctccatgtgcttactcatctttgagggttcatggcatatttttgtcaggagctcagctaagctggagaaagtagccaagtaaaacaacaagccgaaatgaagataacagtcaaccctttaatcacttactgtgatagtgtgagctagaaacaaaacagaggaaaacaatgccacccccttccaatccattttccccatggattggtgtgatggttgaggttcaggtggatcaaaacagacttgagggtcatctttttgatgacatagctctaaacaaaatgagtttgccattttatggatccaggaggtgggagaggacaaggggctagggctagaagtggaaaaatgctgagtactgagtctgaacagagaaaactccttcaaaatgttttgcctctcccctgataaggaggtctttgcaaaagctctgaggaaggcctctgggaaagagctaaaataagtaaactactgaatggaaacacctgatctaggaatgcagatatgcatgagagtatggcaggccggggagcctgagtccttaactgcaactcccttcagagactgcagtgccctggctgtgtatccagtctagggtagggagggcagctttcccccaggaggcctgtccagtaaagcctttgtaattgcctatgtttgagcctaaaaaattcacacacagatttttttgatcagaagctaaactcctcaaccttgtcaccaatatttgttgtatatattggatttggattttttttatttcaccattgtaattgtggtgtctgtttttatgaggaacatttgtggagtactgccaccaccacctatccagaacactctctacatacactttagcaacaggagaccatattgtcattgtttggtggagccaatactcattaacatttacccagatagctaccctttctgctactcattgttcttttccttcatttccatgtttctttccaaagaactttttagtatttctttaatattaattgagagcaaacatttctctcaattttgtgttaatctgggtctctctctctctctctatccttctccctctctctcccctccactttctccttttcctttagcttcactttcaacattatcttcacaagctataaaaactagattggcagttattttctttcagaattttaaagatatcaaagaagttgctacaattaacagtaaagatattttctaagaattgaacagccttgctaatgtagtagttaaaatttaatcaacacatgagcaaacttattttccttatgttcctctcatgatattgaaaatatttataagttctagactgcaaatagtaccatatttttctttaactactaataatgaaaagtgaagctgaaaaattacccacatagacttagttaaaataatgtttctttaataaaatattatatatttgatttattatatacctttttattttattttataagagcaaaagtaggcttatattataacagaaatatgtttgtcctttagaaacttatgacagtctatttcagagtatagccattatgaacgcggttcctataaatactattattctgacaattttctgcaatgttgaaagtaaattaaggctcattattaaaaaataaagttttccaaatttcttagtgaatttttacctttgattactatctataaaataatcataaaatcaccatggaaacagaaattgttgtttcaatattaagaaaacaactatttcattgcgacaaaatctaggtctataaccattacccaaggtataaatataaacttacattaaatagagaaattaagaaaataaagcataaacaagattttttaagggtagtgacatttacacacaaactaaggaggcacagaaaagaatatggcaggtttttttctatttttccactgaataactctagtttttaaaaatagaatttttattggtattacatttattacattgtaattttctgttttatgttgaaatttaaatttctactagataaaggctagagaagaatataaacggtacctggaatcagtcttttaaagtaattgtaataattatgtcaagtttctttaacaacataacttttcactgtttccattaacatgcatttcttttaaaaaatgatttattgaccaacataattgtttctggtttgaagatgggaattgtgtgacatgaattctaactcagaatcatttgaattcaaatctggctacagtcctggagtgcacaaattattccatatagatgtgctagatgaagatggtataaataagagaggaagttgaaatggagttaattagatcaggcttttcctctttaaaagacgacttttgagttgaaatattaagtaattagagacttgatagagttgataggtaagcacattctagttaagaggaatagcttgatttaaaaaaaatgaggaaagagagtcagaagtggataataatagaaagaagtatttaatagcagtgagggattatgttggaaaacagcaaaagataattctagaaagatagtgggaatacactgggggcagagagccacgtataatttattcttggctgtatttctatctcctaggctggtgcatggtgctgaataaatattcattgaaataaagctatgccatttttaccctagcttggaccaagatggtaactgtataaatgaaaaggaatcatttaatctttcatttatcctagactttgctctgaatgcctattgcaaagggaataaaacattgcctcagtactatagatactcccatttttccaaaggctacagaataacaggaaaaaaaatacacatgcatgtgcacacatacacatacagagagagagagttcagtacattttgataagttcaaaagtagagtgatgaataaagtggatcgagtaactctgtcagaaacttttaggagaggaagttttttttttttttgactatcagattcagaaaatgaaaaagaacagtgagaggaaagttttaaaatatctccaaagttgtgcagaactgggagaactgtggtttcagaaaagtgctgagaaaatacaaataagatggttgtatttccaatattttcaattaaatttaaagcattttctgttgttttacctattgtgtaaactatagtaggatgtgtgtgtatatatatatatatatatatttttttttttttttttttttttttttttgagaaagcagagacagcaaaggtagctctgtcaaactggtgccattgttggtgattaactggatgactctgtctccaatatgaactcactcatatacacacttattgcttagaagacaaggcaagcaaacctgcccaattttacagaggagaacaatttcacttataagctaaagttaacactcctgatactcctggttcatggtgctccaatatttgttccacttttcatgatttgaccctacttagtcttagactccttgctgttgatctaacctggtactctgattttggctctttgttttgactttggtttcctaattagaccccttttttttttcacattccaaaagttgacttcttgttgcaacttcatataatgaagtgcatgttcatgtcaattaaattcaccagcctcaaatttaaaatatttccatcaaatttttatagtaagtagcattcaaaatgaggaaattattatattaagatccttaaaataagacaaagtgataaataaagaagtgactagtcaataacatgattaaagatcctgaggtaggggttgaatgggcgcaaggagggaaaaaattcacacacatacatacataaatgaactagatgagggataaaaggaaatcttatgcaattatatggaaaaatacttaaatattgtaagtttacaaattttaaactactttgaatttatataaagtaaaaacaaatcttaatcttaaataatttgtttagggaaagactccacttctttcacttctttttctttttttgggagggggacagcatcttgctctgttgcccagtccctggagtgcagtggcacaatcatagctcactgtaacctctaatacctgggctcgaaggatcttcctgcctcagcctcccaagtaattgggactacaggcacacactgccatgcccagataatttttaaattcttggtagagactgggatctcacgatgttgcccaggcaggtctcttggcctcaggtgatcctcccatctcagcctcccaaagtgatgggattacaggtgtgagccactgtccccagccaagactcctcttcttattgacaagagttgagtaaaggtcaatggcatgtactggtgctgaggaaattgtttcttgcaggttccatctgccagcctcacaacatccctcaaacgagacatgttttggggactgagatctgtacctcaaattgtttcaaggtaaaaatagcacagttaagaattggaagtatttctaaaagaatatctattaaattattttgtaacctctaaagtaacattttcttattgtgcctggaaaaaaaaaaggagtgaaaatttattaaatatccaaagtaaaatcaagctacaggtggcagtggtcctttaagaaaattaatgtattttgcctatactgtctattttatttcttacgtgtatatctatgttaatatttaaatattattagccaagtgactttaagtagtagaagcagaaaatttaagtgttacacaaacatttgctgttaagatgaatcatctttccatacacataactattttcaaatactttagaatacaaaatgctttttaaaatgccttgaaaacaaagaattaatctgacataatcacatccctaatagagttttattttcttatatttctttaattctcttactgaattgaaacttaataggtttcttttagaaacttgattgtcatgatacaatagtagttttgtaataacaaaattcctaaaaaaattaagtaatcatggctgaaagacatttactcgtgtgtaggcaacaatgttctatcattagctcaagtcatctccatatttttcactttaagttaattagactatcacacatttaaacactggagatgtaacaatttacggtagttcattgtgttttgttttccaaccagaacatgttctcttaaacatgagagtgcatcttttgaagagaaaagatatcaaaataatggtgttaattgttgtctagtgtttctgttatatgaaaatataaatattacaaatctaggagccacatgtctatgtaaggagtattttcaaatgaataatccaaagaaccaaaaatattaaaacattccaagttatatttgaatcactgtatgttcatcaccaaatgtcaaagagatggagacacatagtcccagtaatacttacagcccctcagagcactccgtttctccagcacctggtaatttctgggattcttgctctcctagctcagaagaatccttttagccacaacacatcctatttccatatcacaaaccaaataccaatcattcgaattcccatttcagcaggtcctcacattcaacagtgcctcgtctcttaggacgaataatactatataaatgcaagtaaataaaataaaatgtctaaaatattctttggacccagtatagaaattttgataaattatttcttcaaaacaaaagagtatgacaaagtgtcagttttcatgtgagtcgcccatttttttattaaagaattttcaaggataattttgagtcataactctttttttacctttatatgctgactttagatcctagctataaaatatgttggcctggcacagtggctcacgcctgtaatcccagcactttgggaggctaaggcgggcagatcacgaggtcaggcgttcaagaccagcctgaccaacatggtgaaaccccacctctactaaaaatacaaaaattagccgggcgtggtggcacacgcctgtaatcccagctactcaggaggctgaggcaggagaatcgcttgaacccgggaggcagaggttgcagtgagccgagatcatgccactgcactccaacgtggcaacagagtgagactccatctcaatatatacatacacacacacacacacacatatatatgttggctcccacatgattacttgtttaacacttctctcctcatctagacagtaatttccatgacaatatgggaaacctctgctttatacaccagggtggctctgatgactggcaggtagtggcatgctacataaatgttcattcttgggctcttcattcatcctgtggaacctctttaggctgtttcatgccacagactcactggaagaaattgccgtcttctctttcactaactggtacaacttcattcaaggaaacatttcctgaatcagtgaacatttggataaataaaagtaatgtgaatgttctgttttgacattttaatttaataatacgttctaaagtttcctttaggtttttggaattatatttagcttctaaaattttgccacttaacatatgctagaaacagccccattctcaccacagagataatctcccaagtatatgataatcattgtagcttatataacattttctaaatttagatatcccatcagtatataatgatcaagctatttgctaacaatttagaatggaataaaaataataatatggaaatttgcactataaagagcaggtgaagggtagtgtacataattttcactgttttagataatttgcttttgcaatagagtcataaacattagaaagaacaccagaacttaaaataacctgctcacttgggcttgcctctacagcatgtctgtatggtctgcactctctccccagattaattgctttcatatcatgtacatttgcaggaacagtgtgacaaatgataaaacaaaataaggtcacttaatgtgattaaggacaagagtgatttgtgcaaaatattattgaaaattactatttaagttgcattttgcgtgtacttttcagaattttaaaaagagtgatatgatgtgtggagatgatggatgagggtgagatggaaagcatattaatgtatgaagccactgaaacttctgaaaagatactcaagagttttacattaagcatctcaatacctaaaataaagctgtgagataagcattattaatttattttcagatcagaaatctaaggcacagagggtttgctcaaaaccaaacagctagtaagtgtcagagttggagtcttattaaggctatttgactccaaagactaagctcctatcgaccatgaagaacttgtaaaagacaaaaaaaaataaaataaaacaaaaacacatctttattatttattcacatccctaacacattactctggtaatttttataacattggtctccatttttgacatccttgtaatgactttttgtagacagagttatttctctttcctgatgtcagtattggccatgaaacttgctttggctaatagaacacaagtgaacatgatatacaccacctctgagtggtgctttaaatgtgctcacgtggtttgattttaccactctgtttctactcttttttttgacaacagcatgttttgggaagagctgctctttcagcctgagtctctaagacacctagcacagatctgaacaccgaccacaccgaccaaagcctgaaacagagactcagcagaactgtcacagggcatattatttgaatgggaaataaatattaaagccactgatattttggggttacttgacgcatagcataatttagagaaagctaaataatatgcttttcaagcatttaggagatacagccgcagatctgaaaagctaattggtaacatttttacaataggaaacctaacttgtcacagttttcttctactgcatgtgaaaagcagaaagttgttgtagagatatattttcaccccgtgtagccagaatagttttgttgccctggtgccaggaaaagacttctttgtaaatatatatccccactatggtacgagatcatagaaattaattcatcttgcttaagcattgtttcctcgaaggagagagtttttataaataatcctgggagaagttactcagtatgtaagcaatgccttactgtgcatatgtttgtcaaagtaattttccccgtgactggacaggcctgggatggacccacagcaatcagcagttactgggtggaaaggaaataagagtctcaaagcagagggaaacagtgacacaggctgaggaattaaatgactattgtgacttcttttatatcattgattactttatatcgcaatctgaaatcagcaaaaatatttctagagcttatgcattctctatgaacatttaaacatttattacaatatgttaattaaaatgatgcatgcataatctgactcatactttaatttaaacatagccaccttttaattgtgtctatcacacaaagtgtgtatttacaatagagttggcactatttactatatttactatttattctagagtatttagaagatctatttactatagaaaattgttgctatgatttcctggcctaatgagaaaaaaaaaacaaatgctgattaataggccagtgaaaaatttgagtgaaaagacttcaagtcacactgcccaaaagaagattttgcaataattttaccagaaaagccatacaatgcagtcattaggagcattactttgggaagtaagacaatgtagaagtctacagaacctgaagcatacaagtaagtatgttcatcttgtaagctgttacttagtttcgtgatccatcccattaatgtaatgttgctgatttgaatttatggatattatggctttatttctgtttaatttataaatgagttttatagttgcttaaattataagtgtaaagaagctatacttagtttcacatttatatgtattttagtagtgcaataaatataatttaagtcaacactggggttagcaagaattgtacttttccttaataaggcttattcctttacaagaattgtgcttttcctttatattcattggtgaaaacactattttgaaagcataaacttgcctggtattagttgtacaaatttaaaaataaactggatctgacaagtttccaaattaggtattcatttactatatttggcatgtttcttgtgttttgtagtatctgtaaatcatctgcaaaactgacagttaaaagatgagaagttactgtttgtgaatcagcctagttgtttcacttgaagacttttttagttataagagattagggcatttctttgtatttccatttaagaacaatttttaaaaaaattgttgtggaatgatagtttctatttctgttagctgaactcacttctgtgctatttctgttagtttaaatcacttctgtggatttaatttatttcccagttttgcaattatgagggtttttttctgggtttatgttgacctatatatactaaaatttgaatttaaaatttctggtcgctggagaggaaaagttctcctacagagataattaggcaatatggatgtagtttttcaacatgtgctgtaaatttcagtgaggattgtcctctgtaattgcttttagcactttctgattttgtccttggcaccatggtttgagttcagggcacctgaaacacatcattctctttcttctaaagaaggtcactagcctttgtcctctgcactgtaccgagtctgtgaaggaacacaatagtaatcaacaatactacaaataatatagtaaaatctcattaagccttcatcacattttcatgtcattaccatcatgttttttctgaaaaataattccatattctttaacagagacccaaaatagcactttctgtttgtgtggttcttcctctaacattttttttaaattactgagtgatattttttttaaattactgagtgatattttttatttatttgggagaaaaagatgataaaataatgtttttctgttcatattaatttaattattgaagtgtttttaatagtgggtttataagtatttaatgtaagaattattttgaaatcataaaaagatacagtaagtgtgaaaacattaaaataattatacttagggaagtcagagtgcaattgtcttagaagcaattaagaactatatttattctcttattcaaccacaagtatctcttaggataatctcaaaaagcagaaaacagatcctttgtcctttgtttatatattttttaattttgaagtcattaacatagctttttatgtaacccattcagtgtctggaaaatacttatttctcatgaaattaaattcacatttcatggtgattcatttttcatgtagatgattgtgaatttagtttggtaggttggactattttgattcataattagaaatcaggaatggcgtaatagaatggaaaactagtaatatgattactaattaaagagtaagcaaagatctggcttgtgaaaataaaattatgttaatgaaagtgataacttatttcaggatttaaggggctcaggtgggaaaaaattagacatctcaggatatgaccaagctgtggttgagcatttcatatagataaaatcaggtcagagtagcagctaacacaggtcagcaataaaagagtaagaaacaggggggaaaggaggctgctaggagacactgggctgggttatgagctccaagagtactgtagaggcatagtacaagagagctctgaactcctacaatcaagtgtaggcaatatattaggtttttttttttttttaattgcctcaaatggatgctaactctgcctaacctaaacaaaaatgaacgtattggaagactatgtgagagtttataatttccatgagaagactggagaatcagacctgggaaatgataaatctaaagtaactacaaggtctgaaaagtctaactgcgagctagactttcattcttatgccattatttagattataaggagagagtgtccaaatatctgtgccaggttaccaatctatctcttggctagggaagggtaatataccttaaataaaatgttcactaggctataaacaataggaaaagagacaatttctcaaaaaaggggaaattatcaaaagaaggtgaagtagaagttaaacaactaaatatactgataataataatgtcagcaacaaaaggtagaaactatccagagccatgggtatttctatagataccaaaagcttgtgaagggacaatacaataacaatagagacaatgtagcctgggatataattatgtttttattccattcattgctatttcagtgtcttaattgtgattactatttctagcaatgctcccccaccaccaaaatttagttgttctctttgccagagaattctcttcttctgagagactcacctcttattttgcatccaaaaatattttggtttaggataatacagattagggtaaattattgtatcagtggcaaatgatactggagaccaaatttcaagtgaagaagagaggataaggtagacacggatgcttgggttgaccaccgcagagaggcagcccatcaccctgcttatctgtttggggaaaacattataagaggaggtttcaagtcagagaacttgtcaattaaatgcccttggctaactctcttcatagagagttacctattctctatttctggttctctgtaattatcaaatggatgttttctcctcactgctagattttgtgattgtgcagcaaaggaatcatcttttgtgttgaatttagggaaccactgaaatcctagaagtttgaatgtatttttcagaagctccttcctgtcttcactcattaagttttattgaatacaatatgccaggcattatgccaattaacaataattaataccaatctctgaaaatctaatttttcttaacctagggacctgacaatagtgttatttaggattgcatatgctgcctactacattttcttctataaatggcaattttatgagtgaaataagtcagacacagaaagaaaaatactgcatgatttcacatataaatggaatcttaaaaaagtataatatataggaacagagagtagcaatggtagttaccaggagtgagactggattgtagaggggaagagcaagatttagctaaaggccacaaagttactattatgtaggatgagtatgtttaaaaatgaggtccggtagtcccccctatctgtggccaatatattctaagattcctagtgaatgcctgaaatcacagacagtcctgagccgtatgcatactatgttttttcctatacatacataacaataataatcttcaatttataaattaggcacagtaagagattaacaacaattataataaaatagaacaattataacaatatgccagcatcactactcttgcactttggggccattattcagcaaaataagggttacttgaatacagccactgcaatagtgagacagtcaatcttatcagatctgagatggccactaagagactaacgggcatgtagtgaagacagcatggatacactagacatagggacgatttgggttctggaatggagtgggaccctgtgagatctcatcaggctactaagaatgacacacaattaaaaacttacgaattatttatttctggaattttccaattaaaatttttgaacaacagttgacctccaggtactttgaagtattactaaagccgatatatctaagaactcttttcaacctggccttttagatttccaccaaacagttgttctttgatttcagtatataagacttttttcctactgtcatttcacagctgagcaagccatgtgaacctttgaaagctatagtacaatttaacttccaaatgcttatgttagggattaaaaatgcaaactcagtagtctcttggattcaaatcctgaccaaaatacttgctgtaaaatcccttatgtgaatcccattgtgtgccagctatcatgtaacctcatccctgactgatatttattttaattgcatgtgatcttactcattatagttcatttgcataaagagagtgaactgtagccggccagcaagtttaaaacctgcagtatttttttattccctgtgataaactttggtcataccactgatgtcctctacgtttaatggtatcaaaaactcataagcaaatattaactcgttaacatcttcacatattgttttgaccaacacatattctcctaaatttgccaatttaatgtttctaccaatatattaataaaatttgttttttccttatagttataattaggagttccatcaagtaggtgaaagatggtcatataaaatgtatgggaaaagattcctaaaaaatggaacagatgggcatccagctttagcagtgaccactattcactaatatagctacttgccacttttgcctttaaaaatcactactaactaacaaccttcttgctatacaaaatgtggtctgcagaccagaaacatctgtctcacttgacagacactggggcccaactagaggcctactgaatcagattctgcattttaataaggtctctaggcaatgactgtgctaattaaagttagggaggcattacgctaatctaccaaggtgatcagagactgggaataccatgcagagagaccttgggcacgagactcaatcaccatatgtgcattatagaagcctgtggctttatggcatgcagtcctctggatgagggtctgaacacctagacaaagctttccttgcagagaaatgtagattctggaaaggaatggcagtcactcttacatgggcagtcctaggagtacctgatgacccctttgtaacagatgaactgcacaggagacctggatctcttctggctccgagaatatgacagtagtggctttggcagcaaagaaactcaggagtagagcaatttcctaagtccttcagtgaaggactggtggctttccaactggtgtatcacagaaccacagggacagatacagataatttctacataagattccatagcatcttgggttgattctcatgaaacataagctcatgaggaaacacaaaaacaaacaaacaagaaaacaatgccattaagagcattgagaaattatacaaaggaaaaagaagaaaactaaacagcacaagcatcttctaggaaagaagaactggaggaggcagactattacattggcactcacactcaatttcctgagaacctttatatgagttaagtacagtctcttcttagagtcttatcttagaagaaccagtagtttggggcagatttagagcctttagtgtaagcaaagctgactgattaaattggtaagtttttttttttttaaattaccagcggtcgatatagcacagcgaacctagatcttttctttgttgtttttatgtgcaggaaattgctccactagaaataaaccttcttttccttacactgtggttaaagataatgttttaaaaagatgtctccctgttattcacttttacgttttatgatattatgattctgtttcttattttggttacatgattctatatgtatttggggtttatgctttattatagattttgaaaaatgtaatgcttatttgctttgtttttaatttttacatttaaggaacattattttaacaatataaaaatatttcaatgtgatttcaggagtttctagaatgttgcatttatgtaaaatttttacaggtatgtaaaaatgtatttgagaatttccctgggggaattgaagacatatatacacaaaagaatacaaaaagaaacaatttcttcatataaactactttctaatgactaagtattatcttataatggttttacctctcttagatttaattcttatagtcatgtttcttctgtcaattctaacttcaatatcattatacttaattttaaaagtggtacaaaatataagttagctctgcctttctttatcatctcttgacataagtttcctcctgtaggtgctcttatgtacactatgaaatagaagtcttagaaagcaaaaagttattatgtatccttagcccaatctcatactctgtagaaacacccatattaatatatgtcacacataataatctggcttctcttgaacactttcaagaatgattattattattgggaaatatttcctggactaagcttcaccctgcattttcataatgttaacttcttcccaagcttataacctgcatctttagagaagcttaaggctcaatccatatgatagccattcagaatttttaaattgtcaacattttattgctaaagtcttttatgttttgctgtctgccacaatcccttcaatgtgtttcccattcgtagtttctagatcttttattatcttcctgctaatcgttgcatggcttctccctgaattgtcggttacttttgtaaagagtagtgattttacagacataaaggcttctaaaattattgtctgaacaccagaaataaaagctttcctaggtcctgaatgtcccaaactacatttcatcgtatttatattagtgtgacccaagtttaattaccttacttagcaataattttattttgtattgtaatgattgttcaatcaacaaatatatgaaaatattcatataaagattcatataaaataagttcataaaaagctcatataaaatactatttaggcaagtatctgctcatgccgcattcatgcaatttacttatctgaatgtaaatcaaggctttatatttatcaaagctgatattcattttgttaatgtgctttcataattttcctttacaaaaattattttaaatgtcttattctgttttctaatatattagcagcttccctgagatttgttttatccaccttctggtgaccaatgaatggaacagtattaaattatatcccaaagaatctctcttctggactatataaattacatatgtagttaatgacaaaatagattaattagctaatactatttgagtgcagaagctcaaccacttataaatttaccaaactatgtgttttcatagccattttctcttatgttgcccatttggctggcacaagatatttttattaaatatcttggcaaatcaagataatcaatttctgtaacatttaacttatgtagcatctagcatctcaacaggaaatatttatctaagtatcactgggtcttatgaaattaaagctagtttctgaagagaattcctataattaaataagattatgctgtatatgaaaaaggttttataaattttgacagtattatgcattgtaagggattactgagggttgaaaaaacgatctgcttaataatagtctatcctagaatttttttgaaaaattaaacaataggattattagttcaatggatcttcaacaactctcaggaaaagaactagtaataataaatgtcaataaatagttatggaattaatgtctgaatgcctgttgattgtgatgaagtgccaactaaagaaggatttaaggttacattaatttaggtgcaaattttaactttgctatttacttatactgtgaatcctgaataatttacgtaacttttctgagcatcctcaacttcctcatttgtaaaatgtgttaataccacctaccttgggggattaagtaaaataatgtatatgaaataaataaaatagtgcaaaattgtttatttccttctttcaccccatctcttcctccaactaaagatgaaatgaattaattgctttgtgccttagtacattggacacaaaaccaattcatttgaattaggtcaggcaaaagttcagtcatttggctactagtatcctttgataatggaagtattatggtgtgtattttttcacaggggccattagactgtaggtcatttggatgtcattaggagaaagaatgatgatcttgaattgcatagaacatttcgtgctttctcatgctgtgctctttactctttccctttttaagagaaaatctacaaaaaaattttaaactacattataataatattattctatactggaacaaaaaaatgacaaatatacaaacaaattcaaactatggaaaaagttggtggggcaggggtggagactatgaaaaataaacaatcaaaacagcagatatgttcctaaattaaaagaaaattaaatattagaatgactaaagacttcagcaagctacaacaaagccaaggattttttcttctctgtgcatactagagccacttattttctctttaattcacattatactttattatatagtagtagacacttttgctttctttgaacattttattcatttactacaaatgtatattgactctggatgtctgttcagaaatcatgcaactaaacaagaactcataaccgtgattttttttagatggttgaagacctttatggtgcaattatccaagttaatgaaggaatagaatcagacactaaccttgagagtacataatccaaaatttactggataatatactatttttaagaaactgaaataagagccaaacaatggacctctagtttttctaaaaccagtaattacttgtgggtaagttatctaaattattgaaacttggccccaattttcccagctttttaaattacagaattatgctgtctatgattatattagatttttcaaagtgactgtgttaatacatttgaatataattctctcatttacagtttcttttaaaatttttctaccagcttatcccatctccttgaacaatttcctcccattcctcatttgtattgaatatggaaagaatcacttcttaaagtaattaaagttatcagcctaagaattgaccttttttgaatagggttgtttattttgttgttgagttatatgagttatctataaattctgatcattaatcacttatcagatataatatgtgcaaatgatttctcccattctgtgggttttctagaattcagttcatattaacttttaaaattttgttttaattttagacagcatgtctaaatgcatgttcattacatgggtatattgcataatgatggggatttggcttccagtgtacccaaaacacaaatagtgttgtacccagtaggtaatttttcaaactcaccctctaccaccctccctttttggagtccccagtgcctattatttttatctgtatgtccatgtgtggccattgtttagctcccatttataagtgaaaacatgcagtatttgattttttgttctgagatattttacttaggtctccatcaccatctatattgccacaaaggaaacaatttcattttttatggctacatagtattccttggtgtgtatatataccacatgttctttatctaatcaaccattgatgagcacttaggttggttccatgactttgctattgtgaatagtgctgtgataaatatacgagtgaacgttgtttttttttttttataatgatttattttcccttaagtaggtaccaagtagtgggattgctggattggatggtaattctatttttagttctttgaggtgtcttcatactgttttccatagaggtttaactaactgagattcccaccaacaggtcataagcattcccttttctccacatccatgccaacatctgttatttgttgactttttaatggtagccattttgactgtggcaagatgatacttcagtatggttttaatttgtctctctctggttaaatgatgttgagcattcttttcatgtgtttgttggctgcttgtgtgttttcttttgagaaatgtctgttcatgtccttttcccagtttttttttaaattttattattattatactttaggttatagggtacatgtgcacaatgtgcaggtttgttacatatgtatacatgcgccatgttggggtgctgcacccattaactcgtcatttacattaggtatatctccctaatgctatccctcccccctccccccaccccacaacagtccccagagtgtgatgttccccttcctgtgtccatgtgttctcattgttcaattcccacctatgagtgagaacatgcggtgtttggttttttgtccttgcgatactttgctgagaatgatggtttccagtttcatccgtgtccctacaaaggacatgaactcatcattatttatggctgcatagtattccatggtgtgtatgtgccacattttcttaatccagtctatcattgttggacatttgggttggttccaagtctttgctattgtgaataatgccgcaataaacatacatgtgcatgtgtctttatagcagcatgatttataatcctttgggtatatacccagtaatgagagtggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccacttgttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcagttttgtcttttgttgccattgcttttggtgttttagacatgaagtccttgcccatgcctatgtcctgaatggtaatgcctaggttttcttctagggtttttatggttttaggtctaacatgtaagtctttaatctatcttgaattaatttttgtataaggtgtaaggaagggatccagtttcagctttctacatatggctagccagttttcccagcaccatttattaaatagggaatcctttccccatttcttgtttttctcaggtttgtcaaagatcaggtggttgtagatatgcgacattatttctgaggaccctgttctgtcccattgatctatattttcccagtttttaatggggttctttatttttttcttgttgatgtgttgagttttttgtagattctagatattattagtcctttgttggaggcataatttgcaaatattttctctcattctgtaggttgtgtgcttactctggtgattatccctttttctgtgcagacactttccagtttaattaactgtcatttgtctatttttgcttttgttgcatttacttttagggtcttcattataaattctttgcctaggtcaatgtccagaagagtgttttctagattttctttgaagatttttatagttttaggtcatacatttaagtctttaatcaatcttaagttgatttttatatatgatgagggacaggagtccagtttcatttatttgcatatggctagccaacttccccaacactatttatcaagtaagttgtcattttgccattctttatttttgaccctattgtcaaaaatcaatcagttgtaggtatgtgacttaatttctgggttctatttccttttccattgatctacatgtacatttttgtgctagtaccatgcttttatacctactgtagccttgtagtatgaattgaattcaagtaatgtgatgcctccatatttcttctttttgatgaggattgctttggttattctggctcttttttgcttccatgggaattttaggattggttttctaattctgtgaaaaatgacattagtaattggataggaactgtgctgaatctgtaggtggccttgggcagtataatcattttaacaatattgatactttcaatccatgagcatgggatttttttatttgtttgtgtcatctatgatttctttcatcagtatttttagttctccttgtatgaatctttcacctagttggttaaatgtattctaaattgttttttttttctaactattgtaaatgggattgagttcttgattttgctctcagcttgaacattattgatgtgtagaaacgttactgagttgtgtacattgatttcagtatcctgaaattttactgatatcatttattgatttttggagtctttcagaggaatcttagggttgtctaggtatacaatgatgtcatcaggaccagagataatttgacttcctcttttccaatttggatgccttttatttccttctcttgcctgatctctctggctagaacttccaatactatgttgaataggagtgaggagtgtgccagttcttgtgccagtcttgtgccagttcttaggggaatgctttcaacttttctccattcaacatgatgctggctgtgtatttgccatggatggctcttattattttgaagtattttcctttgatgcctggttttttgtgggttttgtatcatgaagcgatgttagattttattggatgcttcttctgcatctattgagatgattatatatatatttaattctgtttatgccatgaatcaaatttattgatttgcatatgttgaactatccttgcatgcatggaataaaacccacttgaccatgataaattatcttttcatgtgcttttggattctgtttactagtattttgttgaggagttttgcatctaggttcatcagggatattggcctgtagttctgtttgctagtattttgttgaggagttttgcttctaggttcatcagggatattgcatgtagttctcttttttgtctgattttggtatcagggtgatattgatttcttagaataagctagggaggaatccttcccccttgatattttgaaataactcttccttgtatgtttggtaacattttagctatgaatccatctggtcctgggattccttttgttggaagattttttttattatcgattcaattttattactcattattggtctattaagggtatctatttcttcttgattcaatcttggctggttgtaagtttttagaaatttatccatttcctttaggttttctagtttttgcaaataggggtgttcatagtagtctctgatgatcttttgtatttctgtgatatgagttgttaatgtcacctttataatttctaattgtacttgtttgaatctccttttttcttgcttaagctaggtagtggtctatcaattttgtttatcctttcaaagaaccaactttttctttcattggtcatttgtataatttttttggtctcagtctcatttagttctcctcttatctttgctatttattttcttatgcttgctttgtgtttaatttgttcctgtttttccagtttcttaaggtgtgatattaggttgttaatttgagatctttctcttttttatgtaggcagttagtgaaaccaacttttctcttagtagcccttttgttttattccagaggtttttgtttatagtttgtctattttcatttgttttgaaaaattgttctgatatctgccttaatttctttatttacccaaaagccattcaggaggaaattgtttagttttcatgcatttttgtagttttgagagctcctcttggaattgatttataattttattcaactgtagtctgagaagacatttgatatgaatttgatgtttttgagacttgttttatggccaagcatatggtaaattctggagaatgttctatgcatatatgtatattctgcctttgttgggcagaatattctgtaaatgtccattgggtccacttggtttgtagtccagtttaagtccaaagttgagtctgtttgtgtctttagcaattaggtgggtctcttgtatgcagcagatgtttgggtcttgttttttttgtttttgttgtttgttttttgtttttgttttttatccttttccactctatcttctaaatactgcatttaggccttttatgttcaaggttaatattgatatgtgagaatttttcctgtcatagtgttgttagctagttgccttgaagtttcatttgtgtaattactttttgggatctgtgatatttgtgcttacctgtccttttatgatggtgagtattatccatccatttccacttttagaactcctttgagtatttcttgtagggttgatctcatagtgataaattcccttagtgtttgcttgtctgggaaagacttaacttatacagtggtattggcaaaattaggcaaatcatctttcctatcattttaactcatttcaattctcaccactctcctcttctatttacaataacaaatagaatcctctgttctgatttattcatgtatagattttgaagagaattctgattttgatgcacgttagaatacgtgaaagagcaaaagaagcaagtgaaaaattttgcagtgacatacaagaaaatgattcagtcttaagatatctgcattttgaataataatgtacttattatggttacatttaaatttactatcttaactgccttcatttgtccactcactgttctatttccttttttttcccaatcttctcaataattatttcctagaatataattttatctctactattggatttttttgcttaatttttttatggtcgggttacagtttaaaatttgcaactttatataatcccagtgtatcttcaaatccttttatttcacttcatatataatgtaagaatcttacaacagtgtacttccataaccttttattgttttttcctattttcacattatactttatgtatattattaacacaatatatatttttttactttatcccttgtcttttaaataaatttaaaaaattttttattcatatatttataatttctgttattttgtattcctttatgtaaatggaaatttccttctagggttcttttctttccatctgaaaaacaccttgcagatctagcagcaaattctctcagctattttgtcctcattttaagaacagttctgccagatagaactttagtattatagtttttattcctatcaggtcctccaaaatggaatttaattgatttctgacttaatttttgatgagaaaactgtggtaatctttgctcctatgtacaaaatatgtattttctcctctgactactttcaaaattttctttttttcactggtattcaacaatttcattagaaaatactttggtatcgttgtctttagatttatccagtaaggttttttacagatcttgaatcagtaagtttatttgtttcatagaatatggaatttttttaagcacttatttttctctctttttgaactccaatccacgtatgtttaacatcttgatatttttaagctgtttactgaagttcctgtcagttctcaccatttatctttctctcttcttcactttggatatttgctattgctgtattttctctgatctcttttgaatagtgttaaatcagctattaatcccatccacagaattcttcacttctgataattgtctttttcacccacacaagttcaattttttcttttatatacttttcatttctctcttcgttatttttatgcttttcttttaattttaggcttgcttatattatctccacctgctctttcatttctttctaagatctttttctactaacctttctatttattacaaattttagattcttccacatgtctgttaagctttaattggataccggaccttataaatttatgttgatgtcattgttgagtttagtagtctttaaagagtttaggctttaatctgacaagcaactaaagttacttgtggattagcttgtttctttttgaggcatattttaaaagttttccaaaatggcctacttttaccctactattaaaatatgactcttctaatgtctttccttaattccttggttgttcaaaaaagtcttatcagaaccgatatatttccagtcctttgtgaattctgagaattggtgaactcacctttatagctcccacagttgttctttggctggccttctgaagtttttccatatatattcatggcttaatattcagttacactctcagggagactcctatgcagatttttggatctctttttccacagtgctcccttttctccagcactttgcccaagatattccatgtgcctcaattttcccaaacacttttctctgtctcctcgacccagaaagcctattatcactaattatccctctctctacctttcacacctttttttcactatgatctgaaaaaatcctggcagaaagcttggatgatatcataggacatacctcacatgtttcttgtctctgttttctcagtcttgtgctgcctacttttcaatttcagaacacgtttgtttcctatatatgtagacaatgtatgtagttatttactgcagtaggctcgaggtgattttagtaactctgtcatggctgaaagtagaattaagtaatgttttatttggcatatttctaaccattattaaagttaaatatttggttatatctccattcttatgacatcagactaaaacttatgaagaatcatatatttttgtctataatttttaaaaatagttgtttacgtgacatataaggtaaaagtttctggaatccacaaaattctggctgttttcactcagtgtcagaataatctaagattttactttcatttcttcccccttgatgatgcagataacttcaacctcagatttttgaattataaaagcaaaaaagattatggtttataattacagcattacatttttattctgcaatagaaattaaaaatatgtcttttctatttatttcagtgctactgaatctcccattaaaacccccacatgtgcctgtcacttgtttataagccagacctaaacatgtgtgccaattatttgtttataaacataaacataaaacataaacataaacataaaatcttgtatttgagatatatgtgttttatatgaaatagtgaagattattcaaaaaattttaaacataacttaagataatttgaaagacttactttcttctatagaattataaaagcagtataaatcttttgctttagtttgaggataaaatttttaatgaaataatttactttacatttttatgcgttactgctggtcaataattgtctagtgcagcatggaaagtgttcttcctcacaagattgaggttgacagtttagtcaataaaagatcattcttttggggcttatcttgctgacacagcaaaggctcattcttaatgcacaggggcataaatgggaactctgtgccttgatagattcagacatggacatcctctgcttttttattaagcatgtcgaactaatgggaggggattttatctcattggcatatccaagagtctctacttgaaaattaaggtaagtgattttggcaacctaaatctgatgactgctgtggagacagaaagtgattgaaggcagttctagctttgattaccctatagttttagaaaagagaatattgactgggcatagtggcgtgcacctgtaatatcaggtaattaggaagctgtggtgggaggatcacttgagcccaggagttagagaccaggcctgggcaacatagcaagattttgtctcaaaaaaaaaaaaaaaaggaatgacaatattggatatgaaacaagttattattctatcatatccttcctaattataaagtaaaaagaatattttacaatggcatagccaatggtcaatattaaaaaggagagtgtcacatatttgaccacaaaataaagaataatcagtgattttttttcttcaagcgtttacttgcttgtttaaaatcaaaacattaaaactgtattttggactgtgaaagtaaacaatattcatttcatatactgtgaaatttttatgttagtttctttatcctatgaatataaacaaaaaaagcactgaacataagcattactgtaaagaaattgtaagtaaaatgtgttttgattactacaaaaaattgagttttacagttaaatatttatatttaatttcaggctgcatgagaacacatggctggaatttagaaaaaacaattgtgccaactttgattttgtagacaaatcactagctgaattgggatggcagatgcatttgttttatgtggccaaaattgaatgccttaaggtaatacatttgctcttcaggttgacacaggtgccaccactccctctagcacacagtctccagaagtagacagtttaaatttgaatgccacacttcttgcttacatggcctacacctcactatacttatccataaggtaatgaaaatcacagtgcctaactcatagcattttttaaagattaagtaaatatccagatctagatctagacctatctgtctattgctggagacaaaatctgacatatagtaagttctcaataattgtaatagttgtagtaagagtaagagtaatatctggtctctccacaaatacgtcttacctccctggcttctgaagacatttgaatttgtgactgcaactctaaaccttaattagtcctttgcactggtccacagcaaaatgactgttggttattgacagaactcctgaccaaccttcatgttagtttacagtgcctatctctctcattgtaattccaccaccttgactgtcttcttgttcactgaacttttgactgtacatagaaggtgacaggtgttttcccagaagtgataccaaccacttcacacagcttttatctgacagtttttaggtctttctgaggagaatttatgacagaaacgccatcagacaagcaggccaacagttgcgtttggcgtaattacgcacttccttgagggaaggaaacagtcaatctcacagtttttagtcaggctgacactatccacatattttgcaaggtacattcacaaagttcaagtagttgattgactgaagctgagcaggaaaggctaaatgtcaggcttttaaggtgaaactagtggcagctctgtagcagcgtggcaggtagagtgaagtctggaattaagagtgacagacgaatggtgggtggtaaagaaaagactgtgtttgctggcagagaaggaagttgggctgtgctcagagcattcatggggtttgattagtgatagaaaggctaaaatatatacagatttaagtgttcaaaattatcttaacattccaaagaaaaactgtcagaattttactaaaataataacttttaatccctttacttttaaaatgttaatatgaattccccttttttttaaacagttttcaagatgttgagatttttgtctaaagattattgtacttattgcattttgtcactctagtctctgctttaagagctagggaaatgtgagaaaatataaattatatcttaaaggggcagagattagagtaaatacatttaaagataatgagaaaattaagaaaatttgtgaaaagttttgattcatcatatttttgtgtgaaaatgaaaaagatatcctaagccaatcaagattttgaatagtctaacaaaacatagtaaatagagcacccttaacttaataaaataaagtatctaatgtgacactggcatgggaaacttagggtattgcttttacagctggaaacctctgtggctggtggtgcctttgcctgagtttttgcttcggcccactgggcttgttccacccactcagcctggcaagtgcactcatctcatgccaccagtccagatcccatgcctgccaagggtgagccaggcacagagtggcaaggggtgcataagtgagtgagcaaaaggtctggccactgcacacagccatgcacactggctgctgcagtgggatgggcagctctgggtgctagcacaggcactgagtgcaagcctgcagctggattagatgcaccataagcggcttctgctgtgggtgtctacatctggacaaggggaatgcagtggtgcccagaagcttagagctgcaaccacagagctccaaagagggtgtcacagccctggctcagggatcacctaggtctgggctcccaaagggctgcagctcttctttccttctagttgcctgcaatgtggcaagtcaggggtgatgtttcagccctgtttgtgttacagctttttcagttgtcccacttccaggaagaatgaagtacatggacaactggtaggtgagaaaggtggagaggagctttattgcatgacagaacagctctcaggagacctgaagtgggtagctcattttcactagcaagtcatccagagtgtccagatctcagcagaaaggagacccaaagtgggtagctcctatccacaggcacgttgtcctgacaagtctccagctctcagtggagagatgaaccacagtgggtagctcctttcacaggcaagctgtcccaacaagtcaaggagacctgaagtggttagctcctttgggcagctgttagtcttaacgtctgtgtgagtctggctgggtctgggggttttatgagctcaaaagggaggaagtgcatgctgattggtccataggcggccatgggcaggcccagaaaaagcaccatacattctcactctgggccacagactccacgtagaactgatagctcggcccacaggcttcaggctgtccccagcttgaaggtggggcttcaccagggaccacccctttctgcccaggaggctgtctgcttcctcccaccatcaacatgtcatccatagtgcccaggctgttcatgtggaagggtgcctgcaggcccatgccaagcagccctcagcccccctaggcctccctcccatgattattggtgcccaaagtttggagggggccaaggcagcaggaggcagtcttgttggcaccaccccaagcatgcacacacgtggccaggttgcaacagcacccaggcttggccacaactttgctccgcccactcccgggcaccaggagtgggcagaggacaggcaatgggagcaggccctttcaagactgtgtgggcaaggggcttcctggattcccaagagtgcagggatccctggtccagagtcatggctggtcagctgcagctgtgcccaggagcgtggggctccagccctaatgacttggtagggggcagagctcctgcctgttcatggcacttgctgactctgtggagtgtgcaaccctggctgtgcctcctctgtgcaccctgcatcttagtaatggtggttccagacagggctggcatcagcagtaccatcagctttactgtgcatgtgtttttgacaccaagtcttttttgctttcttattttggaatgacaagcatctcaaagtcattattttagttacttgggttatataaatcattggataaactaatatctatcttctcactttttggaattggagaaaattgtggcaaaataaaaattattaatcagattctatactattttctttcactagttttagtattttccaagataaaataatggtcagtctagtgctgtcacatagataaacaatatgaatcacagatatgagctaccattacatttaacttttcttaggaaccaaaattaataaaaatttaagaaagaaactgatgaaattaatcttcatagtgtattttatcatgtaatcaatataaaaattcagatatccaaaatatcacttcaatggttaattaatgtaaaattattgagataattttacataatttttggaactgtcttcaaacacttgtattttatacttatggcacatctctatttgattgatagccacatgtggcttgtgttatcatataagacagcacaaattgggatagtttttatcttcattccattcatttattcattatgtgcatggaagtcaacaaatgaaatattaattaatggcaaatatatttttattgtctatgtcttaatccattttgagttgctataaaggaatacctgaggcagagtaacttataaacaaaacttatacatgaaggaggtttatttggcttacagttcagcaggctgtataagaaggagggtgctgacatatgctcagtttctgatgagcacctcaggcagctttcactcaaagtggaagataaagtggaccagcatgtgcagagaaaggaatggggtgtgggagtgccaggctattttaaacaaccagctcttatggttactaatacagcaagaagtcattcacctggtgaaggatccatcaccatgacccaaacattgtccattaggtcccgcctgcaacattaagaatcaaatttcaatgtgaaatttgaaggagacaaatattcaaactatagatattttcaaattattttcagtaatattctcctttcgggctaaacaatgtccagtaatagtaatgtatcttattatgaatattgtttaaattactaaaaacattgctgcaattactattgctgcataataagtcaccccaaattgtattagtgtaaaatcaccattttattatgctcataaattctgtggtcaggatatgaaaaggcagagcagaggtgacatgtttctgctccacaggttctacagccttgaaggtaagtcttgttggctgggaatggctcaatatctgggatctagaatcttctggaatcttgttcactcacatatctgttgcctaatctgggttaacttaaagacaaggatggccaactttaactacatgtggcctctccatgtagtttgacctcctcactgcttggcatctgagattgaactttccatgttggggctcaggactccaagtgcaagtgttgcagcaaatatgaccaaagttgcattgccttatcagactgtgcctttgaagtcacacagcatcatttcgatttccttccactggtttcagctaagtcattaagttcagttgttattcaaaggaaggtgacatagatcttccctctttacttaggggtcagaattttagaacatgttttacaatgatcacacaacttttctttctgaacactttgcttcacaccttctcatatccacggttatgaattctcctgactatatctattgtaacccaaaatattgactgtactcagagattcatcagagatttcatgtctatatgcccagagcctgatataatgccaccttattacacacataatatagaatctgaggactacgttaactgatacatgttaagtatcctgcagagagctggcacattggatgtgctcaataattgttagctttaagtatcttaaacagctattattataatgataagtctttgttcatgtttcatctccatgacttgtcatgtgttttgctctgattacattacttgaattcttgaagcctctgtttctcttttgtaatgtaggtaataatagtatattttataggatattaatagtatatcctataaaatgagataatccaaataaagcacttactgtagtgtctggtacatagtaagccaagtatcttatgaaaatttgtctagaaattttaactgagacaaatttctcaatgaattattctttttaatcaaccaagaggaggaagtagtaatttattccaaacaatagataaagaaaaattctggccagtttaattctgatgtattttattacataaggtcatttgtgttctggaaatagtctgagactaattaaaatcaagtaagtgtccagattgacaataataatcattgggtgtctattggaaacatttataattaattaaacaaaattaggattgttagctattttcttacatgtctgattcttaccttagtacagaacattaagaacaaagttgacacaaagttatattgtcattctcctatctatatatttcaatatattcaagtccttcctaagtggttaagaaattgctattcaaatgtgtttataattttatactccagtaatgactatcacagtttaaaattggttaattttacctataaccatgtggagagtatttgaatggtaatgagaactactgttataacaaacgtaactcatttttgtttaaattatacctttattttcacaacagttcaaatgcatgatctgtaatgaatcataccatattggaaacgctctatcaggctggtgtgttagctgcagtctttccccactctacaatgtaactgaaaaaaaaaggccagatattccacttaactaaatctaacccttgttgaaggatctctcattcatgatttttttcataccacccacttgatttgtatttcaaatatgcagtattttctgggacattgttattatcttcttacatatggttcacagatgatattaaaactcttcgaaagtctagatgaagcaaagctgttagaaagcatcactgagctaagttaggagagctgggatctagtatctctccattgctaacaaaataactgattttaggcatgctacagaccccttcaggatgatttgctctataattgttggtgtggtatagaatctataaggtcaattacctacaaatgtatttaatttcataaaatatgctatagatttatgtctcatcataatgaccaatgttaattttacaatgcttttataaactaaaagttagatatagtttgggatgctgtgagatactgatttaaattcctttattcttaagtaatcaataacattcttgacttatttcctgactccatctatctatacactaagatagagctgccttagtaacagagatcgatgatagtgatttggatctttgatttctttgtctcttcattttcctggttcaaaactgacacaacattttctttaacttctgataaataacagtgccttttaaataaaatacagtaatgttagtcctcttgtccttcagtgaacatatgaacttactgagatcagtatcatggatgattaggttaagaatgatttgagattggtgagttggaaggtttccaaaactaattgttgaattcctgaatatgactaataaaattaatgagtgagatctgtgcctatgtataatattatttcactttgataaaaaatggatcagataataaaatctaacatgttcaggcacaatgcagtgccatacttagtctatttgtaaacttttcagtacagccaagtgtattcaataattttcagatatcatgttcctaatacattaaacttaatttaataaataatcaaatgttagaatgtatttcagtaatttttggaatgactaagatttctagaagtccagtaaaatttaggttattttgtattaatgaaaaattaaacagcaaaattgctcagtaaactctttgtatttactgtcagaccttacagggaacttaaattattttatatttctggaagagtgaaggagacatccctgcacaattataaaatatattcttaaaaaacacatttttattatatagtatatgctaggcactgctaggaggctaaggtatcttgcattattaaatccttgcaacaacgttgagatgtaagttattataggactgtcataaaaacagaggcttaggaatagtgaaattattaacccagtttagaacctgaatatagccaatgattttatgatttagtatgaccacatatttgatgatagtggaatatttttaaatttttttattttaatttctgtgggtacatagtaggtgtatatatttatggggtacatgaaatgttttgatacaggcatgcagtgcataataatcacattatagagaatggagtatccatcccctcaagtatttattttttgtgttacaatccaattatacccttttagttatttttgaatgtacaattaagttattgaagtccatagtcaccctgttgtgctatcaaatactagtggacatattttaattggaaaaaatctggatgatataagaatagatcatatggcagaacatatacagaggaacttacggaaacaaagtaccacattcccacaccttttaccatttttaaattattgatatttaaggccaggcgtggtggctcacacctgtaatcccagcactttggcaggctgaggcaagtggatcacgtggtcaagagatagagaccaccctggccaacatggtgaaaccccatctctactaaaaatacaaaaattagccaggcatggtggcgtgcatctgtagtctcagctactcaggaggctgaggaaggagaatcacttgaacccaggaggcagaggttgcagtgagccaagattgtgccactgcactccagcctggcaacagagcaagactctgtctcaaaaaaaaaaaaaaattgatgatttaatagctataacattttatttgttcttagtcctttaaaaagttgtgaatatttaggtgtgtcttttttacgtttctttttccattaactaatattattttataataagaagacatgcagaaacaacagaaactttgctaacgcttgtgttaaagatgtgggatccctaagttgagaaaaaaagaaaatgaaaataatcacaaagagataatagaactgctaaaacataacttctttccatctcttcatatcttcttaggatcataaagaaactgctagtcagatgatttttctcttccactaaaagctttttatgagtggtttgccctagagcagccctgttctatgccatattattcaatatctagggtaatgcaacccttgtttctgcctcactagctgttcagtgattaatatattcagggtcctcacttgacgtgagacttttaggtcaaccttctcccagcatatgtgcttgagtccttgtggttgttatgggtattttttttaataatggtgataaattgcattaagtaatttagatctctcactttccttttaagtgtcaggtattgatctatatgccatgatgtcagtcattctttccctgaatgcattaaccttctttctctatgtttgtgtctgatctgcctgtctagtttggaataaaagccctctgggaaaagtctaattcagtgctgtgtatattcttaagtgattgtgtgagcccattaaatgtttattaataaatataaattgtcaacattattaatatttattactgattcatagtaatgacaatagtatacatgaattatgggaatcagataactagatctaagttttatttttgttaataaaggaagtacagttaacgtgtatatacaaatatataaccatataatatgtatacatattcaataattattgtttttcatgttcatattatagtagaaaatgcttcctcagtgactgttttacatttcatttaaatatactttactcttaaacaacataggcaaaatacaactaaatgttgtttgcattgacattgtagttaatcccaaaatgccctttttttatacattaacaaatattccaaatgtgctgagcactctgctacatgttggagacaaaaggagaaacaaaaaatggcccctctcctcaagttgcccaacatgaaacatacacacaagtaaatgggtgcttgcagtccagggtgccgaatgctgagactgggatcaggcgtggaaagttcatccaagaattccttaaaaaacgtgatgtttggccaggtgcggtggctcatgcttgtaatcccagtactttgggaggccgaggcaggcagatcatgaggtcaggagtgcaagaccaacctgaccaacatggtgaaaccccgtctctactaaaaatgcaaaaattagctgggcgtggtggcacacacctgtaatcccagctactcaggaagctgaggcaggagaatcacttgaactcaggaggcagaggttgcagtgagccaagatcatgccactgcactccagcctgggcaacagagtgagatgcgtctcaaaaaaaaaaaaaagaaagaaagaaaaatgtgattttcaagatactctcctgatttcagaaaggcactgtccttgttaaacactatcatgtactaactaaatgcaagcttcaaaagaaccttagcagatatttggtttcaattttcatgtaagaaaatgagaacttagagaaatttgtgattaatttatccaaagacatagagcagaaatttcattccaagtctgccaggcacatcaaggcttaaactctggctgtttactaatgactctctatttaaagtcttaagaatccaataaatcagaaagtgtacttggatctatgtaatagaaagtcttctgtaatttcatctattaaggatgtataataaacctacaatttgagtgactgatacttaggatccacagaagaataacaactaatattcaaatgcttagtctcacagctactacagttgagctagtacagttgagtttgaaaatcatactaagcaatgttttcccttctcaaaaaactgcatgttgctgatttctatatattcctagggttaaaggtcaatcccatatacttattaaattaaaaaaaaagtctcatgaccctaataatagtctaaacttattggagaagcatgttcttttcttctacttggaccaaccattgctaaagcaccatatgattttttgtgtgtgtgctctctacatcactgttagaaaatgactcatttggttcattttttctgggtcaaagagcaacatgggtgtctcaactgtccaagcctaaaatattgactgctactgaacgtatcattaaacacaacattcagtaacttcagccctggatttcagtggcagtactcacacttaagaagcagaaaggaacagacatagcccagttaaatacagctagaacacagggttatcaaacgaacctacattaaaagtggaccttttcttgacacattctggtggcaaaactgagatacaaacttttcagctaaatgttgctgtagtagagtttatattaatttctagaatttcttgaggttgaaagcttttttgaggcgtaatggcaagagagtaagtcctagagaattattcagttcttgaggaattgataattgactttaacttacagttcattatccctttacaatgatcatattgagtttcacattgctttatcttatgtattaaatgttatttcaaaatatgttttccaaattgtgttccagtgatatttgttctataagatagcagtttatgtagaaaaatggaacaatgtcaaagaattctggggaaatctaagttaaacaaaaagtatgttgttttaataatattttatagagcttttcattccccagataagagttattctacagcagcatttctaaactaatttgatcagaaaacctcttttgattgaaagccaaaattaaggattttttggacaaagtactacaatatgcatagcatactgtagttactaaaattttaaattaaatatttatatgaattaaaaacatgtaaaatacaaagagctgttgaatgagactttccatgtgtctcagtttattgctgaaactccaaaactgagagcatcagattatgagtagcccacattctactaaggatggctggacacattcacaataactgagtacatgatgacatgaaaatgggtatgctcagcaatttttagccttcctcgagcacctataatagaaggccaaaaattccaaaggatggtagcagagtgctgtggaagtagagttgtcagcctcctaaagagtatgatggcatttcatattttctacccacacaccccacacataggaggtaacctctgctccctcccctaacccaagagaaacattgacagaactttggggtttgcttgaaggtccagggtggcatcactctcctcagctggtgaagtgctgggctgtagaaatgtgtaggaccagtatgtgcatttcaggggagttaagcaagataatttttgagacagccttacctaggttgttaaattaaggaatgtacatggacatctgattcccctgtcacctttttgccaagctgtgagctgttatggtaaaacacctttctttatgccatgataaggaaagaaatctgtgtttctgcattttcagattatgtgttggctcactcagagggcctacctaataaggcagaaagaagccataaggtatgccactggaaatagttgccagggtgggaggtgtgttcgggtatatataatgcacttaggaaactgcagtactatttatgtgaggtgtgtaacagagcaatgttctctgaagacatcacaaatgtgactcacaaaaaagccagcgtttccagatatgccatggtggagggtgtaatgctcagccagtattaatgccaagtgagaattatagcagaattagtacataagacttttgatgtctacctgaaattcctcttccactgcattgaccctggaaaaaccaaaagaaataaagaggtggaaggagagctaaagactgagccaaattccctcccactgggagtaccagaaccacagccagacctcaaatggagggaaaggaacagcagttaactgaatgtaaatgcgaatattaaatgtccccaagactggagttattcataaagaagagaggtgttttttgttttgttttttattctttcccctgtctcccaacataggacttgttttttttttgacatggagtttcgctcttgttgcccaggtggagtgcaatggcatgatctggcctcactgcaacctccgcctcctgggttctagcgattctcctgcctcagcctcccgagtagttgggattacaggcatgcgccaccacgcccagctaatttttgtatttttagtagagatggggtttcaccatgctggtcaggctggtctcaaactcccaaccttagatgatccgcccgcctcggcctcccaaagcgccgggattacaggtgtgagccaccacgcccggacttgttttaaacatcaatagtgattatgaaactacagaatctcaatgcgatgtcttccaaggatctgaaagggattcctgaaagaaaatcttaaacatatggataggagaaaaatgtagcttttttcttactgtatcctgttagattcagcctgtccagtaagccagttacagagatcatgtttaatttccaggtaattaactttatgttgaattaccagattactgtattaatagattaaaacaatacaaatttactaacttactgtgagattaattacatgaaaaccattgcagtagcatatatttcatatgtataatttatatgaaatagcttatgaaatattaatgaacataattcactgtgaaaaatatattttagaacttcaggttatgtatcaggaaaatacttttaaatagctaatattatactttattatcttaattcatagctaaagtccaattattatattaattattttcagctgatcatatctggtaacatcagaaccagagggcaaatgccaacctaaattaactctctgtgtcacattttaagagaagagcaataagaacgctaaaaggggaaaagaaacatatgaatgtgaaataaactcagccactctgttgtttaaaattattaaaaagtcatatataatatttctatatcatgtagcttgtggcaaagacatcagtcatcacattatctgtacattgaacatgataaattgattgtgttctaatgagaggatctaattactcagagaaatgaagagggcatatgaaagctttttagctccaatagccatatattatcattgataacactgaatctggtgtggtttaattcctttgttctgtacattttggaagatataatcttcctaattcatttctttaaagagacatcagatcatcaatttatcatactcctaaaaatagcaaaaggaaatatcacaggaatatgaaatctgtgcaatggtcatcagaggttttgtacttgggttccaccccgcccatgccaggctttgctaaacttccacaggtagcaaactaaagcttccacataattattgtttcaaaatataattgtaaaacttattcagtaatttctacaggatatctcatgatcataaaattatgttggaacccttctatagtcacaaagtagaatcaagattcagaattatctcaacagtgtgtcactcaaggtcaaaataaacaagatgaaatataatagcagaactgaaaacttgtgtatttgagtttcaatgatcatttgttcaaacgtagcataaggagatataaggtgtgaaatgagtgactgaatgagctcattctcagttgagaaggaaaatattgcacatttgaaggacgctcatgtggaaggaggattagatctacaggcaggtgaacctatggaatttaccactacacagtttttaattcaagaaatagcatgttaacaaccagagctatcaaataatggaattgactgctttgtaatggggtgagttttcttcctggtgtccttggatactgccaagcaataactgtataactatgtcgggaaagttgattatataaaaagcatttctgcagtcaaacctggaagtaatgattatatgacttctaagctgtctcctctgactttaagacttccagcttgtattttttttcacttatgtaacctttcaactctctcactggtatttatatttcgtcttattaattataggcataattgcacatgtctttagttcctttatagatgtttttctatataacaaattttataagataagtaactgcattgtttttatattcttctcttctgtgggaagtctagaagccttggacttagaacatgccgaaagcatttgagtgtatggtgaaattaatacaggatagtattttttaaaatagcatataagagaaatatttattatagtattaaaataacattttcctgagttatctttcaaaaactgtgaagagtctgagtttttacccaactggcatgttaacaaggtaacgtaagtcagttttatggatgctgattgaatacctgagacatcagggtcagaaggtaccacagtttcgtggatgttaacagaagactcaagactcctgagataaagaaaaatgactttattatttataatacagcaaaaagcatagacatcagcatgtttgggtcgcttcgccttgccaccagatctcaggggtaagatgcagatgggcccagatagtgcttacacactcagtaggttgcattacagaagataaacctaagtttgcataaggaacccaatttttaaataacagatagtaagcacactttccctcttctccaagggagaaaatatctattatcctgggctgtttgttataccaatatccttggaaagatggtccaaaacaaaattaggtcattgcctttctcacaagacatgcagaaacatgagagagccatggctaatcgtctcccaatatcactcataaaatacttctacatcgtgaactgaagagggcaggacttgagccagacctggtgtaggactgtgtgatgatgatggggaaaaagaaagaacacggaaaagcaaatgaaattcacagatccagtgtgtcgaagtgactttgaaactataatttacctttagttaaataatctgtatctagaattggcagtggctatatattgatatctatgatatttgtggcttttatttcttgataggacgcctgattccatcttcaccatagctcttttctttttgttgttcaatgtgaattttgtactatagctcttttatattttattgtttctatgtgccccacacatgagcagctaaccagtgcattttggtttattttttggccaggcgattctaaccaggatgggtgacttaacagaaaaagaaaagcaaggacaatctacataacccataaaacccaatttccaaaaggccaggtcctctatttaacattctcataacttgctctgtttccataccgcagggaatagcaattctgtttaaaaaccataaggaaatggtagcagatattatcagaaatatataccaggacaggacccttttttactttaaaagttttaaagataataagtttcctttcaaaaataaccgtgctcactctcttcaggaataaccaaagctttcattttctttgctttctttcttttttatttttgctgtcttttgaaaggcaagacttgtagattgatacagatctgtctatataagatatccaaaatatatagtttaaatttccttaaactctgtggaagtttctgccataattactaattttaatctcaccaaatctgttgttatcattaacaccaaacactatttataaagcacttaattgaatgtgggcctgtgaatactattgagcaaagctaattaatgcataccaaaattaagtaggctattataatgggacatatcccacaatagtacatggaacagaggaaatatccaccaatttatggttaaaccaagaagactgggtttataagcacaaagcataaaaatgaaaagtttcagaaaatgtttcagtaactatgaaaataaatgaatatcatattttctttattaaatttattagttctgccttcattactctcaaatttgcacacaaggataaggatattgcccactaatagataaagttatctcatctaatatacacatatttagcttgaaggttgtttgagaatcaaatcactaagacaggcttctttgggtgaatatactgactgcactggtgaactccaaaagtatattagagcaccagcattagactctgtattacattacaacatatgactgcttttttcacattacctacttatagtgcatttctaagtacattagtttggatcttatctttttaatctttgtatatggtgtaaggtaggggtccaaattcattctttctgcttgtatagtcccttcttcaccaacaatctactttaagctctcccctgtatgtctggtcttccctatattgtgagttctattcactcataatttgtgatttcttatagtttctgcagttcaggctttcaggtcttccatattgtctgtgttcttcttaagccttcttagcttctgttctgtcaactgataaactttcctcatgcgtcgccaatcttcaatttagagtcctgaataaaaaatctggctgacactaaacactgtgatctctatttgggaagaattttcaaaaagatctctagtggcttatcaattggcttttgtccagtaggacacaggctttttgcatttaacctctaacagggtatcatatgaaatagaatgggatacttataacatgtagccatgtgccttctcacagagtagaagactttatgaaggtaagccttagctgtgtcaggcatttgtggttttaagagtccagtgtaaatctctgtacataggccatttataatttcacagattgtgtcttttatctccaagttgattcatttaaagcagaggtctgaatagtttattcattcttcaccttagacctaaaggaactctgcatatattcctttggtacgagataaaacttctcctttgcaaagtgaacaattacctccataactgcctaaactcaggtctagtctctcttttgtccagatttaacacaccattatatgcactgcccttcctcagaacctttccacccacttgtttatgatcatcttccttgtagctttgcctcatggacaactatttcttcactgcctcactcatagtagcatttgtgtccactttaatgcttcttgtagctttttccacatcagcttccaccatgttttctgtcctactgatctcaacattttctatttagcctcctttacctgcatttctctacctaaatcctcattcagttcatatttctggcttctgatttcccatcccactttaagtattatctgtccatcaaccccaatgcctaaaaagcattaacatctctgaaatatgtattttcacttaatagtgtagttcacttttaggaaataaaagtcacagtgcagtctacaataaattagacaaaataggatattataagcaatataatcatgttgcctagcatataaggatgtattaaaaacaacataatttattaaattattgttcataagacagaaatgttctttcttttttgatccaaagtgagaactttttaagggcttattttataaacaagattgtactgaaattcatatatagataaaaatgaacatgatttattatgaacaatttcagtattcagcatatttatattgttattaataagattgggagcagagagctaaagcattttactttgccttaaaaaatgcaccaattatcagcctgaccattttaatataaaaaatgtttatattatagtataaattattaatcaatctgccacaatcattactttagttaaaactgaacgtacttgtggctagcataggaaaggagacattttcatgttaacgtgaatttttttaacctaaattattgcagcctattgatcctagatctgaatcttcaaagaaaactgatttatttcattaattggaatattttaaccagagaagtctatcaagttggggtttcaacctgaatgaaccttttccatttagaaaattgatcttccagtcacacttttatgaaccttgagcttttagagcatggttgcttttaaagacagatcatctccagtaacatcttatatcattgacaggttggagtatggatgttagagcaaactaagtttgtgatatataaccacccacatacagacaaaatgaacaaggcatatatttaaatatgcaagctagacaacatgcagagcagtgagtaaggagtaaatactgagtcacccttagaacataatatatgctggtaactaaaaaggtgggcacggggcaggaactccataaaaataataattctgccatgatgtcttttatttaccaaattacatctccaaatacattgctgtaccatctatataaagaattgaaagtgtctttgaacacaattacttgtgttgcctattgactcattaagagaagagcattgttggaatgtgatttacttagattaacagtggtccctacagttaattgggcacagagtgaatatctcaaagtgaacagctcacaaagtactggaatatttatcagagaactaaatgactgatgtacaatgagtctacttgttagagtatctacagtgtaggtttggagtcccaaaaaacaagatttgaattctggcagcagcacttaaagccatgtgcccttgggtaactttaaaccacctttagtttttaaaagtgtgaataacgggcacttttaagaatcttaatgttaaacaaaatgtttgaaactgttctttcaaaaaaggaggccctctacaaataggtcacaataaaatatgaaacataactgacaagggtcatagaaaatccattttctagcaacattattttttcctctctagaaaatcacagagagtgaagttaaaaccataagttttttttttttttttttttggcatccaagaaatcagagcaaatgggatttgtagtatgagcctgatcattaaggcatgcatctccataatggaagaaaaccacacgctcatgggaacagcaggcaggatcctgagcaagagtaagcccttccagagggcaaggtgagagaaacttgcattccttctcaaaccactcattctttcctttctgagcaccaaatttcaggtgacacacacacattctttaggcatgatatgagatttgctcagctaagaatttcttagatattctatgagtttactatcaaatggacaagaaatcaactacataaattgtgacacctaagtcacaattctgtttacttgagctcagtgtaaattttgagaagatgtcagggtttttggttctacataaatatattgacactcaatcaagtcattattggtgtgtccccttgcccatttatccaaattgctgctgttggcagttttgctttgtattcccatcactatctatacttcagttggtccatattttagctcttcaattgtgtgagttttttctcagcaactgccatatttgaaaaccatatccctcttctgtgtcgcaaagacttattatgcatgcttctctgacacctggttttaaattctcaggaaatactggacaggaaccatcagtttttcagggttaagagaaaccatcttgtccagcaaataatcccttctttttcttttgttaagctaagcctcttgccaagaaattctaatttaagaagtctaatttgctggtcttagctgtttgattgcttctggttcccctgtgatgagtctgtggaaacaagggccacagtgaagtcaacccaacccaaactgcagaagtgagttacttttctcagtgtctgtggtttgtcttcaagcgcctgttagacacctatggaaaatttttcctgatctcaactctcctggataattctgaatcagctaattaggtgactagagaggtagcaaattcctgggtttacaagcatttttttcttccattgattttctttgatttgctcttgctctaacttctttccttctatcctgggacttgatttgtatatagcaaatatgacaaatcttactgatatcaatagagcagaaagggggaggctggtagagtctctctgttacttaaagaagcaggatgagggtttaggtgacaaaaaaaatgatagttgatagaaaacaagaggctacagattcaacagaatatatgctttaataggaaaacgaaccttttaaaagctagcttttctgaggaaggaaaatctaaaataatgcaagtcatctgactaagacagtgaagtttcttcacttctcacaaaagcaagaagaacaggcagaagtttttctaaagtaatgaaacatagtccagtggaataagtcctttatcaccgtggcgcttagtttcctcaaaattctctgaatctatcattttatgatttaaggtcctaaaccagactttcttccccaattctctatgatattttatggcaccaccatctacctagtcattcgctccagaaaacttacatagattttgtgattcctcccttgtgctcacctcttaattatcaaattctgttttattgtccaaacattcttgatttttctccctcctttcaagctttactcccaatatccttgttcagcctcacatgagtcctatactgactgactgaaatagcactgtaataggtttctgtgactccagtcttgtctccttcaaatccatgctccatggatttcaccctaatgatgtatctaaagtagggatcagcaaactatagcttacaggacatatctgggcttctgttcacttttgtatggtccataaacccccaaaaatgttttcttcatttttaatgatttcaaaaatcaaagaggaataatattttgtgacacatcaaaatgacaagaaatttaaatttcagtgtccataaataaaggtttattggaacacagccacactcgtttctttatgtcctgtccatgggtgttttgtgctataacagcagaattcaatagttgcaacagagatcatagaatccatgaagtttaaaatatttaatatctggctctttacagagaaagtttgttgatccctgctcttaagcacaaagactattgcatcatttctcgaatcaaaatattttactgatattctgtcacctgcaggagaaacctagcctcctgagcatgacatacaaacctctgctatctgagccctattctctccagcctcacccttgtttatactgttgccttgcactagattgttctgctctgccttggttcctatgcttgtcttcatggaatgccttactcctccctctttatcatgtaactttcgcattacttatttatttttaggggcagggtcttgctctctcacccaacctgggttacagtggtgcagtcataactctcactgcagccttgaactcctgagctgaagcaatcctcctgccttagcctcccgctacagatgtgcacaatcatgcccagcttgtactacaggtgtgcaccaccatgcccagctctgtttctcatttctgtagaaggagtattgagatcatctcctccagggaaactctgtagacctccatgcagaatagtaagtcctccctgacttctcttgtcctacataccacattattttatgaatatcgatttgtgcttgtgtctaaactgcaagctctggattttgagcccatcaatacttggaaaaggatctcattttttttaatcctcagcaaatatcattgtctcacacttaatagtggctcaatcagtgtttgttgaataaattaaaatgtcttatatatatctcaactaacaatagtcttttaggtttaaggaggactttacataatactataaacagtatcatctgataacaaaaatgtagcattaaaattatttgtaaacatttctaatcttttctactatgaataatgctacaataaatataggagtgcaggtatctctttaacattttgattttcttttctttggaaaaatatccagctggatcatatggtatttctgtttctagtttttggagaaacctccatgctgttttcaatagtggttctctctccacgttctagctagcatttgttactttttgtctttttgatcatagccattctaattgtgatgagatgacatttcattgtggttttgatttgtgttttgctgatgattagtgatgcggaacattcaattttggtatgtcattacaaaatatctgattttcagtttagggacactgtaaaacatataaccttaagattatttagatgtaaaaataaattgctctcatagggctgaataacacatttcataaatatttaaacaactctgcttgccattctctttattatcatgtatcactgaccactaaaaatttcatatatgtgctatgattatagaataaattaaaacctcatacatgtgaaatattttatatatttaatattagctagaagaaaatatttagcatagttaaatttagcattaatatgtcatagcatcactttgtacttcttaagtatatatatacaattgtaatttgtcaatatgcaataaaataaaaattcaagataatactttgtatttattttgtaagtcaaaaaacaatataagaaaataggcttcttcctcccatagaagttagtagaataactgtagcaaacatatcactaattaaacattagtgaaatgtcatttttaaagaatctaaggcaatatatatctattgagcttcctaccatggttaaaacctactgttaattattgagatattcaaaggatttactccctttgatcttgctaatgagaaaaaaatatttaattctttaagtgttttatcattcattcttttcaccctctccctcaacaacaacaacaacaatttggattgattcaattgcatttgtaaatgtatgtgtatgtgtttcttaaacaaaggaaattttattttagctatacactttttagatctctttttcttcaaactagttgttccaaaaagaatattttgcttttgttatttgcggagggatgtgagaaacttgttcaggggttagcaggaggtgttttttttttttttttcttctgccattatctgtaaaagtatgaactctcatgacctagcctaatctgatgatgggtcactttctgttttgaatctaatttttatgttgccaatctttgccagactgatcggtaatatcctaagcacatacacttatagattttcacagtgctgtctgtcaatctttgacttatttcatcccaaaacttttaacttgggaatttgctgttattatttttgctttaatattggttttactattttgctttttcccttctaatacagaatagtgtaatgtttaattacattccatcccctaatactcatcctcagttcatcaaatatcgtccttttctttttttaatcatgtgaaattagaacacctctccaagggctaaggtgaagcatttggttctttatatataaatacagacaaatcactgattgtgagctattttctgacatttttggtttatgctagactgtctcttggctggacttatttagtttatcttgtgaccatccactttctgttatttgcctgctgagcacacatttttgcttttgcagcctgtgtagaaaggtctgcactttaaaaagttaataggtaaaaggaggttggtatttgaggcaaaatgttttcctaggaggatccccatagctgacatttgctttccttctagatctcacagactgaatttgcaggcctttgggactctgtgcacagcccatctgttagagcaaagctatgccaagctgatctggatatgactgagaggaatgaggaggggatttttaaaaattacttttatagtcattttctttttctttaaatacaaagccacattgttaggatgaacttgattctgccatccaaggcaaactgacagtgtggtattagaaataaacatcaaacagaacctgttgaaatgtcgggttatattggaaaggtgtcaggtttcatgtcatatgtgtttctgttcaatgatttccatcatgatgctattggttatcaacaataactgaattaagttaaacaatatgttcaggaaacatttagtaagtgcctataatgtataaactatgtggaaaatcttagatatgcaaagatatctgagatgtggttccttctttcaagaagtttgcaaacaggggatagcagagcacagatgtatccagagaataaaataaatgtcatttaatatgcacaaatagcatagttttaatattgatgccacttatatcttagtactatggataagcaattcactaaagtgtgttatgtatgacctacatttaatcttataacaagttatgtccattttagaagggaggagatgagatgcagacaagttatggccccagatatgagaggtcatcaggaggataatgctttgtctcaaaacctgtgtttcccaaaaagctacaatgcctagggaaagcaaagacagagaaagagaaaatcaaaaatgtacttaacagtggggcagatgctggcctctatgagaaattacctagaaactaaacatccactttctcggccttcctgggacagtggccttggaagagtttctgccgggaagcctactaatgggatttaaattaggtcagatgaagctggttttgctctgcttcacctaattccatcttcctgcctttgaacacagatgcagtggccatagctgctgccaccatcttgcaacatgagaaaaaaaaaaaagagaattccatgcatagaccttggctcagttgagttgtgaacatagcatagccagcagctgtcttcctcccatgtttattgttaggagaaaaaaaaactaaagccctgatggtttaagccattggaaaatcagattttttgttatttgaagcttaatggaaacttaagtaacaaaatctatctttaacctaaactattgaggctatgatgctattgtattcttcctctttttcaatattttagcttccttgatttgtataactccacttacttttgattttggaataactgtctggttagtcacactttattttctctgtagactgttctttcacttcctacatcttaacgctatttcccaaagttcccttcttgtctcgtaattttctcactgccttcagcatttgtactgcatactctctcttcgtgacctcatccttctccttgttgttaaagaggcatgtagtgttgccataaaaatgccttaaccatgacatcatatgcagtgacttcccaagctgtatttctagatctttccctcgagctccagactgaaacatatccaataattgcatcaaattcaaaatatccaataactgtttttcatctttccctacaaatcttgttttctaatctattcacttgcccaggtcagaaatctataagtcattttggacttctctagattgtctttttatttctagtcagacaccacattctgttcaattgtaataacccttgactctatttattccatctttatagccactaacttagcctaagcttttgcagtatttctcatctgaattactgcagtcagacccttaatggatctccctccctcagttctctcattccagtcaattcccctacattcttatgagagtgattttccttaatagaaacgtattggaggcatttgtccactgagatccttcaggatttttccagagttttaaagatttagtgcaaacgtttagcatggcatttcctgaccttggtttagttatctaatctcttctgtatctatcctatcacttgcattcatttccatttatccagttaataaatagctattgagtaaatgatatgtatggaaaccaggctaactaactgctggggctacagactttgtcctggccctcgttgaacttactgtcaagtaggagagacagataataaagtcagcaaaataagttcagcctgtgattagtaaaataaagaaaatagatttctgtctttgagaataatggtaggggagagtgatttatattacatcatctgtgaaggtctctctgaaaaggtaatatttaagctgaggcttgagagatgaggatttagcaatgtgaagtgttgaggattgaaatgtcctagacataaagaacagaaaaataaagaatataaatttagatatattaccactgaactgtacacctaaaaatgataaagatggtaaattttatatgtatattgtacctccaaaaaaagaacagcaattataaatgtcatgaagaggtaaagaatctggaagtttctagaagtgatcaggccagtggggtaggagaataaggaatgagaaaggtggtgttaaaatgaactatttgaaattcttaattcccccaaaacatgacacactgactattgcttcttgcttatatgagcttgctattattattgttgttattattgttactttattataattaatattacctaaaaagcttcctccttttgtctttgtcaggttaaatgttactcttcttttaaattcctttgggatttaaatggatgaatgaatgaacaattggcattgtattattattattactataaataattgagaaaatattaaaagagtcagaaaaggagagtgggaaaaaggcctctgaggtaggtgtgagatttcacttggcttcacagtcacaccgtgaggcttacctcctgcccactgtagacaagaggcaggagaagtgaagtaacacattcacattggcacatgagtaagtgaaagagctaggtaatgactccctgcctggctggctgcaaagcaagtgcaaactttaatttaaaaaacagacctaaataataagtaacatttaatctgacatacatggacatttgcactatgggctgcagatatgttggtgttgttatggtttgattaattgtctgggtggcttactgtcacttcatgaaggtgtctgctaaaatgtcacttcctgaaaaatgtttttcctgaacctgtcttaaggaaacttcaccaccactgctctggacccttttatcaggttttttttgtttgtttgtttgtttgtttttaatatctgacaatttctattcactttcctactatttataagagcagagcctggagctcaaaaactttatggaaccaatgacttgaatacttgaataagaaagctaatcatagcttcttccaccctcacagttttatcttaccaattaaaaatgaatggatatttttctccttttataaaattgagtgcgcttctgacagcacagctttagattaatctatttgaatctcttacaataaataatcagcttccatgccctatctgcccaaatattgtattttaggttgcttgtaagccgtgaaattcaggaaagtatactaagtaacatgtggcttattgttagtctatacaagaaagacctcgattttggctgccttttgtttatctcaaccacttttatcttaagcctttgctatctacacaaagggcacatgtcaacacatgcaataaggtagatccagaagttccctccgtgcaactgtgaggctgatgtgaaatgtactgacaactgtccctaaccctggtgccaaaaacatagtcccatctcgctgctgctgccggcagggtgggctgtactttgctgcaagtattcctacatacttctaatttgaatttttgcaaagcatttaaagtatttctgtaaacatatcagaaatacaggaaagcttgccacaccctgtttaagaggttattgtctctgatactgtagtacattttaatagggttgttttccatctattcttattccctcccttaacctcatatcaatttgagatccatcgatgtgtcacattcgggatttgttaccaagagaaacttaactgtcaggtttcctgttcttttttagaagacgaagaatgctctgtagcttttacttattatatgtgatagatgaaggaaaacagttgagtgcaacaaatgtataaaagcagaatggtaaatctttgaaaagctctttggtgccaccatgtggataagatttggtagttttgaaactatgctgggacattctgttcttcaaacaattctacttgcatacacaatttttgttccactaccttcctaaaatctagttctcccattacccttgaaaagatgaatttttattataaagtaaatcaagggaagtctcagaaattgatctgaataacatttaacttttcagccagagctcacttgctctttttttctccctttgaatgtgaaatagggggtaagacctcatttataagcttcatttgaggattttcaataaaagaacattatatctgaactaaatcaataacttttacttgggttttcatcctcatacacagcctcaggcctgagtacctctgcattctaatcaaagaacatcgtctttttatttacaaacattaatatggcttactagaaactattctaagcaatccacaaaaaccaacatttgctctttttgacaaccctttgtggtaggtactgtcatcatcataagcattaccaccaccaccagcagcagattctgtgctcttaacctctgtgctccattcacctggtgctcatttcaatcagccgatgatttgaggagcctctcacttaacactcatgttctcaatctataggctcaaccctgttcagttttctaggtgatcctgactcaggcagataggttctatgcccacagccatggcatcattgtgtacattgggtctattattagtccatttgctccaaacctagattctgtagtgccatgggcatgccctgtaaatccccaaatgtactggcaatctttttctccctccctattgtgttggcccaaccggtatgaactcctgcctcagtaacctagcacaccatttacatactgggggagaacacaaccccggattctgacctcctctgaaaggctgaactatgatgctcgtggctaagtagcataaatatttccattgaaatgcccctgcttccaggttaaacctaggagagccaggtttaagtatagccagagttatttgtgagattcattaatctgcacacattccctgtacaaacagccacacacttgggtccattctgcgagcccctgggccccatcctaactcctcctcagtgcatgttattaagatcacaggaggttttcaacccaaatcagtccagctcttttccattgctctgctatataataactgtacttcttttggtattcccctattcctatggtgctcttgcactctcatacacacatcaagtatctcccctcagtttctttaaaaaggtgccaatctgttccacatttgacaaagctttctctgataattggtctgcagcagagagtttactaatttcttcaatcataggaaattgaatgaatcgttttcagcaaaaatcccccagttatttgagcaggaacatgctttggtcactactgaccttgagcttgtaaataatccttaatgttagtctttggtttcatgtgtgtctgcagaattgggagacactgtcggtacttttttacattgttttaatttaaaaaacacaaggacattgctttagagcctggaaccattctgtgaaaacagaagacaacttaatatggagtctttaataatttagttgaatatatttaatttaattttctcctgaagacatcaatatattttaagtttttctctaaagaagtggagggtctttccattgcatgcacgtaattcaaatatggctggtgtgtgcttctaagtgtctatccaacctgatgttgaatggctgggaattcatacatggacctttgttttttacaattagtaggtgtagtcttgtgataaatgaatgttttttgaaaactgagtattaaaaaggcattaaagggcaatataccatacatatatttgtttaaggtctttatataagggaaaagctcagtgtagtgtagaggaaagatttggagtcatagaattgagttccaattctgctctcaactgtattaacaacttaataatatttttatttcagtgaaaactttttatgtaaatggagaaaataatgctgtccttctagaagtggggtgtgtgtgtgtgtgtttgtttaaagatgataaatctaaagtgccacattcgggactcatacattttaattgttttataatgattatttgtgttatttttaactcaataaaacccaaacaatatctatcttttcttttcctgtgtcttttccagattttcttcttccttctcttttccccccccttttcttcctgcttctttctcccaaaaagcagtaaagtatggagaagaagcaatacatatcacattcttacagaccaactgcttcatttcattttgaccctctctggccaaagtgcatttataatttacagtaatgcaataataaatttaggataatttacaaaggcaattttggttagagtaattaaatatgaactcagagtaattataaattcaaaatgatttttaaactgtgagttagagaaaaatcagcaaaatatttagcaaaatcgtaattcaaaatgaaggaacctttgcatattttcatttaaaatttaaaatcagtttagatatctgacagttttctccaatgtgtcccaacattgcccataggtagaccacagaatccccaatcagtgtcttgctccactcttaaccattaggaaactgcagaaagcagagtaattcggtccacttgggcatctggatcgcctgccctggacactgagcattagagagctctgctctgctctcttcccagcaatattttcctctatctgtatgtccactaccaatgaggaacctattgtgtatatacttagatcctccgcccttcttgtcaacctgtgtttctcaaaccctctggggtcaaggttcatttttctctttactgttttgaggatcaatatgttgataaaaatacaataaaaataaatttctaaaaagacaaaatgtaatttaaaagaaatataagcatctaggtttttttttttttattagcttcaacagacatgtaagtactcaatcgagttgctgtgaagtttctgagtactcagtcaattgctgtgaagtttctaagctcttattctcaattttgtatatatcttgttgcggtctagaaacagtttccagacaagctgtttatggacatgctttgagtagcagtgttctaaatcacactcccaatattcaggccccccgaatttcctgcacaaaggtcccaagccagccacaattgcctagagcatctcctccaggatcattctcccaagagtggtgaaggaatcccttggccctcgggataacctagggtaaactgttggtggatgttgtgggcttgtggacagaacttggacgtatgggccaatctgtccctgcagggagacatgggcacctcatgcaggactgggatgggaatgggaagaaaggggcccaggatcctagcaattcctcctcttaccctcttgctccattcccaggaaacatttgagtggagatgcgattgctgttttgtcagctttttctatatttctgaaggccctgttgttccttgagcctggactccctggatctgctagactaatcctgagctttgctcctgcctcccactttgcccttccccagggctgcgggttttcatgttcagtgcatttgctccatattactcctgtttccttttctgaaaatgaatcttttaaactattaggataaagtgtgcctatcctaaattcatggatttctaagatttttataggaatgacacagagtttctgaattctagccactgtaacatctcattgccatgccacctctgaaatgtctgtgttgatgaccctgatttaggacccagatctgccacgaatccttggttcagtttagctcagcagaaatgtgttgcatatctgcagttgagcaggcaccacgttgcgttctgggattacgatgctgcataagaccaaacccatccactcaaagagtgtaacatctaataggctttttttttcttttttgtaaatgtggaatctgaaatccagagagttgaagcaatttgcccccaatcccacagctagtgcaaagaagaagttgcttcaaaccagattttttggctcagtgtccagggacctttccagtatatcattcttcctcatatgtctcagaacaaagctagtagacatttctgaaaaacgttcacctttgctgcattgctgctccatacatcaaagagatttacacaatcttgaggttctataagatctattgaatccctcccaatgtgtaggaggcacagagaattggaaacagttaaggggtctgagtttaattctgaggaacttaaatttatagtttttctttgatcaacttaacctgttgccttcagtttccttgtctgtgaagtaggaatcatctatgtcatagagttggtatgaaaattaattatatacgtgaaagtattggtaccattggtgctacctcatattaggaactcagtgcatgagaattccttcccctttcttgtctgttttgtgaaactcaaatcctttagtcactagatgtaaatgtacacattaaaagtattcattagaaggtgcaaattcactatagccactgcctagttaaaattcactataaccagtgcctagttcaaaacttgattttttaaaacgattttttgaaacaatttcagtttaacagaaaaattgagcagacactgcagagttcctatataatcctgaatgctctgcatacagtttcttctattattagcatcttatattagcacaatgtatttccggtaattattgaaccaatgttgatgtgttagtctgttctcatgttgctaataaaaacatacctgagagttggtaatctataaaggaaagaggtttaatggactcacagttccacgtggctggggaagcctcacaatcattgtggaagacaaaggaaaagcaaagggatgcctcacgtagtggcaggcaagagagagcgtatgcaggggaactcctctttataaaaccatcagatctcatgagacttattcactatcatgagaacaacatacgaaagacccgcccccataattcagttacctcccactggatccctctcatgtcagtcacatgggaattatgggagctacaattcaagatgagatttgggtagggacacagccaaaccatattagttgataaaccattaactaaaatccaaagtttattaagatttttttcttttagtttttaccgaatgtcttttttatgttccgggatcccatttagactaccatgttatacttagctgtcatgtcttcttaggttctgcttgactgcttgactcccagactttctttgtttttgatgatagttttgaggaatactggtcaggtgttttgtaagattcttttctgttgtattttgtctgatatttttctcatgattagactgcagatagagttttttggaaggaacatcacggaggtaaggcaatttttagcacatcacaacaaaggatacatatatcctttatgtataactgttgatttataactgttggtgctgatctggatcaaccagctgaagtagtgtttgtcagatttttccactgtaatgttattcttcgctgctcttctttgtgtattgtgctctttgaaaggaaatcattatatacagcccacattcaaaaagagtgagtagttatgttctctcctttagagaggagtatctacataatttatctggaatcctcctcccgcatttataagtttattaaaccacttgtttatatcagtatggaatgatgggtatttgttttatttgggggttattagccatgatatattttacttattttgttactcaaatacttccagctttggccactcagagctccttcagtgggttcctgtgcacttcgacgtctctccgtcaatgtacatgtgtgtatgtgtgtatattttgtttgtttagcattttcttactttgtggcagtacaagatgctccaggttcagtttggatatttcctactccagtatacaatcagctatttctgcaagcatccctagttgtttctaaaggagaatggcatttgaaactaagatctggacactaggcatgcttgtttctactgcagtaccatttcctttaggcatttggattttaatgtccacattcatggtgttattattatcacagtttatcctactttacagaaaactaaaagtggtataataagatgccactgagtgcattttggaaattttttattcacataactttttccagttttttgtgatttgattgatgaaagtgtcattaacttcctaaaaattatgatgtacatcaaagaggtgaagtgattatctttacagcaaataaatgtttatatacacatttttcccatttacctaaccattttcttcctagcattataaccatcccattttctctaggactgaggcagttcacagttttaaaaccaagaaagtcctgggcaagaattaatcagccactctattcacagctctgataaccattataattaggtattaaatagagacacttagagatatgcgggtgtgtgttcatacatgtatatgaatgaacacatacacacacacaaaagttgacattatgtctgaatattttcatcatagtatccctaacttattgactggttcactctattaatatttgtaagttaaatgagtgacaaggttaattgaatgaattcatagcctgtttgattaacgcaataaatatatggtcgtacatcatataagtatttacacattacatgtctgtttttagaatacttttcacctactttctcattatcattgtatctccactttccctaaactgtagtaatgttgtaatatttgggatagtttaaaagctttgtttttatagccatgtctatagtgggttcactcccccaattacacaaagcactctcatactagtaaacaaagtgttggaatttgcatttgtggatgtgaacatttttttctgtttttggttatttgtctccatttttttaaataaatttactgttccggtttttttgttaatttttgtatttgtatttgtcttactagtcacagctcttttcatagtaatggtattagcctattttctaacatatactaacctttttctcttagattgtggtttgaattgtttgctatgtagaagatttatattttgggattttgggggtttgtgtgtttccagtagtgagatttatttattatttcttcataacttctggctctggtgtcatttgtaaaacttaaaaaatgctatttgttaaaaaaaacagcatgaaaagtggtccatgtggttgtctgtatattacccaagtcatgaatacctagcaatatcagttatcagaaatgacaaatatcataaagtcacatcaggagagcatagtaaaggcaggagagcatacttaagttgtaacactttccctgtgacaaactcccccttttgtaggctttgttgctggcatataccgtatttatctatgagccaggacaagaccactaatgaatcttataaagcttgagaaagtgactatgcaaaagaaaatagatccagcctgttactctactccagaagagagatgtgcaaggactttaaaaataaacagtcttcaatattcctttccggagataatacgattcttttatgtgagatatgtaactttcttttcctttaattactacaaaaataatttgaattttagacaactctgtgctatttgggagtattactttgtgtgagttggtgcaaaatggaaaattacaaacatcatttaaatgtcctctgaataaactaggtataaaaagagtaagaaaaccaagttcaatatccttggaacaacattgctaatgttatttttaaatgcatgtttatgaatccatagtgacactgcacaaagaaaaaaatcaccactgcatgtaaattgcttgcattttccagtaaataccactttagttttcgtagtaaaatttactgtgcaaaatggattatactcactcttccctttgaaggtggttgcaaagtgtgttttgtgatccaagttcatggattgcagaagctcttgaaaagattacgggtttatgagttgctttaggtaaagaagttaatcaaatactagaaaaaataaaatatctaggtaaacacacaatttcaatataaaaaatttaaggtaggcagagttatgcttgtcttatagaattacagtctgagacctgaaagcctcaattttcataagaactaaaaatgaatcatttcagaatcaagtttaacacagtaaacttagttgcaaataaaggaaaaacataaaatatatacttaaagaaataaacacccttgaactttttactgtgttctttcacaaaataattgatgctaaacataatcacaaaatttgggcagaaagctcatgtgacattatcctgactcttaatgataataataatgataaccatagaatccaccggatgttgaaaatgtgcaagacactgacacaggtacctcgcatgtggtaactaactgcatcctcttagcaaccttaggaaggaactgctattactatccccattttagatgagaaaatttagacacacaatggtgaaataagttatccaaagtcacacactaactgaagtaggcagaaattcaatgtagatataataggtaatatccatttttatcacttatagaatcctgttgatcccatacaataatgtacagggaaaaaaagccttttgaaaaattgtaatgcccaacaacatagctaaagcattaacatcattataggttttttagtctctcaaatattttcctaattcatgcaaaattattacttaaggtcagaaatccgcagtttttactttaaacaattttcttcagatttatatatatatatatatatataatacacaaatcttgccatttatatttcaatggctacagaacttgtagcctaccagccaccttctctcgttggtctaaaaagtatagaatcttgagtcaaggggtcttctcttccaaattcatctccacaatttataagcttttacagaataactaaattgttaggccttagcgtcctcatctgtaaaatgggatccactaatagtacctatgacactgaattactataaagattagtgtttgttagcatcaattttcaaagataattagttgaagcatattgtgcctggcacacagtaagaactcagtaagccttagctgttgctgttgttattaatataagtacgagtatcagtattactctcagaataggtattattgttggtgttggaagtagtcttataagaacaaactaaaagttctccctacactcaaattctgagctaatattataggaatgaaatcacaaaggccatctgacaacataaatcttcctgacttgagattgcttttcagaatctagaaggacacataagagatggatctcctgcatggaagagtggtcactaaactttagattacatcttccctatttctccagaatgactgtgcctccagcccttcaatctccctcagtaataggctgtttaacttacttgtggaatattgtatagattctcaggtatttaaggctggaaagaaccttagaagtgaattattaggttggtacaaatgtacttgtagtttttgccctatttttaatggcaaaaaccacaattacctttgcaccaacctactagttcaactggtgggctctacagagggctgtaaagtcaggatttgctgctatggaaagagctaagactacagtcagattgttcctcccttctttccttttttttttttttttcattttctttgtttggaaacatttgcatattttctaaaatcttataaaatatgctggtagatttgaacccacagaacagtttccccagaattatccaggaggatatggtacaggcactgtacatggcattttacgacctcaataaaatatcttcctgaaacctgcccttgaggaatgatggcataaattactgtaaaatgaggctttagaggcagaaaccacttatttccttatgtgctactatatgttcagtccttgtcacagtgcctgacagctaataggtatttcaaaaccatataatcaatatgtgtgcttttttaagcagcactttttcatgaagttgcactttaagatatttgtagttttttacggaaatatttctaaaatgaattgttacttttttgctctactcttttattaaactgagtttacctaatttagctagtcccagaggactgttagagattctttctctcctgttagctcttatttcccagttgtatcagctttaaagagccccctttcctgctatcatgttaaatacattgaaaaaaaaaaaaacagaacgtccttatgcgtagcatgggcatctgcatacaatagactatcaatgtcagtatgtatttatataccatcttattccagaaaagaatgacacctgcttaaatgctcaataaaggtattgcagagttaaattaaatgtgattaatcagtttaaacagtgtactacaaatataagtcaatacgttctaagagagcctgactatagaactttcgtcttttttttttttttttttttttttttttttacttattattatactttaagttttagggtacatgtgcacattgtgcagcttagttacatatgtatacatgtgccatgctggtgcgctgcacccactaactcgtcatctagcattaggtatatctcccaatgctgtccctcccccctccccccaccccacaacagtccccagagtgtgatgttcctcttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatataccccgtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgcctagtcagttttcccagcaccatttattaagtagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgactcggtgatgcaggctcttttttggttccatatgaactttaaagtagttttttccaattctgtgaagaaagtcattggtagcttgatggggatggcattgaatctataaattaccttgggcagtatggccattttcacgatattgattgttcctacccatgagcatggaatgttcttccatttgtttgtatcctcttttatttccttgagcagtggattgtagttctcctgcaagaggtccttcacatcccttgtaagttggattcctaggtattttattttctttgaagcaattgtgaatgggagttcactcatgatttggctctctgtttgtctgttgttggtgtataagaatgcttgtgatttttgtacactgattttgtatcctgagactttgctgaagttgcttatcagcttaaggagattttgggctgagacaatggggttttctaggtatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtggatttgtcatagatagctcttattattttgaaatacgtcccatcaatacctaatttattgagagtttttagcatgaagcgttgttgaattttgtcaaaggccttttctgcatctattgagataatcatgtggtttttgtctttggctctgtctttatgctggattacatttattgatttgcgtatattgaaccagccttgcatcccagggatgaagcccacttgatcatggtggataagccttttgatgtgctgctggattcgttttgccagcattttattgaggatttttgcattaatgttcatcaaggatattggtctaaaattctcttttttggttgtgtctctgcccggctttggtatcagagtgatgctggcctcataaaatgagttagggaggattccctctttttctattgattggaatagtttcagaaggaatggtaccagttcttccttgtacctctggtagaattcggctgtgaatccatttggtcctggactctttttggttggtaagctattgattattgccacaatttcagagtctgttattggtctattcagagattcaacttcttcctggtttagtcttgggagggtgtatgtgtcgaggaatttatccatttcttctagattttgtagtttatttgcatagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgcagagctgagttcaattcctgggtatccttgttgactttctgtctcattgatctgtctaatgttgacagtggggtgttaaagtctcccattattaatgtgtggcagtccaagtctctttgtaggtcactcaggacttgctttatgaatctgggtgctccgtgttgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagttacttcctagtctcgatggtctttacattttggcatgattttgcagcagctggtgccggttgttcctttccatgtttagcgcttccttcaggagctcttttagggcaggcctgatggtgacaaaatctctcagcatttgcttgtctgtaaagtattctatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacaatttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcttgcagagtgttttccaacttggttccattctccccatcactttcaggtacaccaatcagacgtagatttggtcttttcacatagtcccatatttcttggaggctttgctcatttctttttattactttttctctaaacttcccttctcgcttcatttcattcatttcatcttccattgctgataccctttcttccagttgatcgcatcggctcctgaggcttctgcattcttcacgtagttctcgagccttggtttgcagctccatcagctcctttaggcacttctctgtattggttattctagttatacattcttctaaattgttttcaaagttttcaacttctttgcctttggtttgaatgtcctcccgtagctcagagtaatttgatcatctgaagccttcttctctcagctcgtcaaagtcattctccatccagttttgttccattgctggtgaggaactgcattcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgctggagtaccctgccgtgtgaggtgtcagtgtgcccctgctggggggtgcctcccagttaggctgctcgggggtcaggggacagggacccacttgaggaggcagtctgcccgttctcagatctccagctgcgtgctgggagaaccactgctctcttcaaagctgtcagacagggacatttaagtctgcagaggttactgctgtctttttgtttgtgccctgcccccagaggtggagcctacagaggcaggcaggcctccttgagctgtggtgggctccacccagttcgagcttcctggctgctctgtttacctaagcacgcctgggcaatggtgggtgcccctcccccagccttgctgcccccttgcagtctgatctcagactgccgtgctagcaatcagggagactccgtgggcgtgggcgtaggactctctgagccaggtgcaggatataatctcgtggtctgccattttttaagcccgtcggaaaagcgcagtattcgggtgggagccacccaattttccaggtgccggctgtcccccctttctttgactaggaaagggaactccctgaccccttgcacttccggagtgaggcaatgcctcaccctgcttcggctggcgcacagtgcacgcacccactgacctgcgcccactgtctggcactccctagtgagatgaacccggtacctcagatggaaatgcagaaatcacctgtcttcggcgtcgctcacgctgggagctgtagaccggagctgttcctattcagccatcttggctcctcccccgactatagaactttcatacagtacatgaacttcataaaaacaatttctctgcttaaaaggctttttctaatttacttcaaggtttcctatcctaatgtagacttaggttagctgtagccttgtaggatttaaagagagaatagattgtaagagatgagttctaaattcagacagattctcaagggcatgattcttatgaatatgtataatgtcaactctagcctatgtggatttctagtcctttgcagtgctaatttagccattattttcaagctctttttctatgaaaccaatttactatgactttttggtaaggcttttataacatttgctaattacaaggtgacatctgcataattattaattatgaagttacatctgcataatgaatattaccaataatttaacttaaatgtttcagttaaaactttaaatgcatggaattaaccagaagtcacaatgagttgctactgtatcagttatagaattgagaaggaaacaattcaagacaaacatagtagtgaatgaaaatttgagctttaacactgcatgaatgagaggaaagatgagtttgatgccacaaagaaaaaggggtcatacgtggtaataacctggtagagagttaagagaaagtctcatcccaaagtatatttcagcatgaagggcttgttaaaatttattctaggaagaatataaaagtgtttgctttattggtaatgttaaagaaatctacactgtgattttctttgagctcagaattcagcctcagatatgagcatcgtttactaggccaggctatgttctaagtatttaaaaattttggaatcttatctgagccactaaattttgagcagattttacagagagtggcatcatttcctagaaaaacagcagcaacaaatgtggggaaaagagggatgtcctcagggttagtgtgtccagggatcaggacaacgctccacagagtcgaggggcattagtacatataattattccagggaagtctctctcagaggccataagaccaatttctatttagtttccttgctgtcatatggaagagattgaagtctgctggcatcaatgaggtaaggactctgccatcataaagtcctgtggattatggaaagcccatgtagaaaataatgggaaataaaggaaacaacaatactgtttaatttgaaaaatagacatatctgtgtctcaagatgtaagaattgacgagtacacaccaagtcgttgttatctacgtggaaaaaaatagtaaatgtatttattattagaggatgtgaagtttggttgtgacaaattaaagactgcacctttttgagatagtcatgtaacattttcagtgactatctcttaaggcattgtgcacaccatactgcttaaaattcaagatccttgtgactgaaagccagttctgattataatagacacaattctcaatgctaagttctaacaaattaaatgtgtccctgaatgtgacagtaaaacttctaagttttattccattttcaaagattagctcagttccacttgtcagctgggacatgctgttagatttgttgttttattgtattgtttaaatgttcagtgggcacaagtttttcataggtaaagaattaatgtgtcatgttatcgtgacacattaattttagatacatcagtctaaaagcatgaaagtttattttgatccagttcaccgcataaaataatcactacccattttcacttcaaagggcatatcttgatatgtatagaaggatagtgttgaaaataattgtgtttatgaaattaataaatctccaaagtagtggtccaaaaaatattttaccccttaggtcatcctactgtcctgtaagttaccaacagtaagtagaattaaatttacatactcttaatattgagatgattgctgaccttgagaataattattttagagaggtagggagaggaagttgtcaattggggtgcattaaggggagagtatgagatgagaacatgaaatgaaagaatacaaacagcaattcgaagaagtttttctctaaataggagcaggaaaatcatgtgggagttgatggtgaggagggatgttggtacaaatagttaccctttcacatgatgaggactatcacaaatatgctgtgggaaaaaaagagtgagaggaaaaaaaatttaaaatatccttgagcaaatcaaagagcatggaatccaagcctaagcagaaggatttgtttcaacaggaagggaccaatggccccatcatgaacgtggaaagtctgaccatcctaggtacatgaggttggtaggtctgatagtgggagatgagatacttctctttcgactggtactattgtctgtgtgaaataatcacttgaataaacaagtcttgacagaaaagagttgaagttttcactttgggttattgttagtctttagagatcatcatattcaacatccctctctgtccaggaatcagatgaatagtgctcagatattttgaacatggccatccagcaatgagcagcttagtttttcaaggacagccctttctgtgtttagacatcactaatttttagaaaaccttttcttactgtactagttctctactgcagctctaacaaattaccacaactgagctgctagaaacaacccaagtgcattatcatacaattctgtaagtcagaagcctaacgtgggttttactgggctaaagtcaaagtttcagtaagttttgtgttcctttttggaggctataggaaagaatccttttccttgtcttttctgatttttaaaggccatgcacattccttggcgcatggccccctttttcatcttcaatgccagcaccattgcatctctctgtgtgtttctgctatggtcatatcttcctctgactgactgcacttagaaaaggttctctgcttttaaggatgcatgtgattagattgagcacttctggataatcaggacatctccccatctcaaggtccacaaccttaatgccatctgcaaaggcctctttttgtcttgtaagattacatattcacagtctacaaggattaggacatggacgtctttggggaacattagtctgcctaccacacttgttttaggtttaaatcttttgcacactgcctcttgacttaccctatcgaattgtgaaacaaaatagagtcattctttccttttccatagaataatcctgtcagatgtttcaatgtaaccttcaggggctcttgtcttttacctcccaaaatttctcctaaacttctgtgcccataagtaaacataagtcatactgacatcattgacatcatatagtctttttatacatatagagaaatgcattcatagataatttgaaagtcacagagtacacagaaactggagtttatttgaatagtgttacagtatatcttagaattatgtcatagtgtccttttcaaaatatgaaaaacaagtttacatgtaaaattatgttgaaaagaaagtgatgaaactgtctttcaagcaagttgattttaatttggttcaatttcacagtccttaattgaacattactggtaccttatgaaacaatctctaccctaatgacctggggctaattgggatgatgggcacaaatggttttattgtattatagtaaatgaaatgatatagtaattataggatgcaataggaaaatagcttcgggcagaagtaaagaactcttcctggaattgtctcctgtgctaaattttagtagatgagaagttaggaaagtgtactgtatggcaagcactttccagacaacagaaatagaagaagtaaaaacactgtgaagcaccaaacattatagagagagtgtatttggtaagtatcaagaagctcatgaatagtactagtagtagctttaaattctgattagcatttactatttatcagctaacttttctaagtgctttattattttaaccttcatagagatcccataaagtagataccataattacctaaattcattagttcagggaactgaggcacaaagaggttaagcaacttgccaacaatgtatagcaaatccaaggtttaaaactctggaagtctgaaatcaaagattctgttacaccatacaagctctcaggatgaccagaatataaagaataaagcaaagagtggtgaatgataaggaatgtcagcaggagtttttgttagagctggaaccttaaccagtggtggaggggctcccttgatggggttaaacagaagagtgtcatggtcaagtcacatgtcactgtggttgtcattgtggttgtggttatgtggagggagtgggaagtgataaaaagagaaacacgctaaaaggtaattcagagacaggggcacttatccaagtaaaatatgacaaaaatatagcagagttagcaaagaaaaaaaaggctgaaaatgataaatatttaggaagtaaaataacaggatgtgatatttgtatacaggagtatgtgatataataaaaatgagataagagataacactcagtactatagtttgacttttgaacttttgtaatttactaagttagagaacacttaataagagcggaaaatacgtttaagttgaacatactgagataaagctgcatgtgagaattccaggctgtgccactaggcggcggcatttgtgcgcctgcattgtgcgaattccgcccaagctttactctctgcatgatttgtcagtgaaattctgaatgtctaaagacctctcattctccacttctgttgtattattagtttctgaccacacgatggagtcatttcttcacatttcctcacactgattttgtttattaagaaaatcaatccagtcaaacactagctggaataaaagacatttaaattttcagaatattcctctaaaaatttaggttctctttgacaaggaacataaaaattaattcagtgagtattcagaaccagcttcagattatttaaaatgaaaattgagattcctgaaaaacattaattaatccaggaatattgattttaaaaattgtttagagacactgaaaaagcataaatatataactacttgagaaactttgttaagtctgaatcaaatttggaattcatttaaagcaggtgattgactgtacacaagtatattgtcaagctgcattctattttgtgtatgatcctgccaagttttaataaatattagtcttcaacctttaatcaataatgttttagaagagagtaacaataaatggtattggtagagcaccttacagtttgctgcgctttcacagccttatttcgtgtgacactgacagaccagtcaattaaacccctattccaaggaaaatgtaaagaactgattctagacaaagaaaaaattagtactattatctcccttcaccttacacatttatactgcctctggtacactcttgctctttaacaatgtatcttcaatttaatatccaaaatctgttacaacgcttttaaattactgcaacaatagaagcatatggttcttaacctttcagggttggattgaatgacctaaaaagggcttctgaagtcttcaacttagcattcgtctttccaggtcaaataatccctcctattttttctcgcagggtgatcagtctttttggaatgatctctctcttagaccatgataattttccagttctttgttcagaatctgggtacctgaaatccctatcccagatgatgtttttatactaaggcatagctgggaggaagcctcaatggaaatactgtcattcttaattttacagtcatctagtgtgcctttcactgctctccagagagaggtcttatcgagtggctaggattccaaattcatggacaattttcagtttttatctcctagggtctctttaatacatacagcatttctttcttcctgcagaagaaagaaacactttcttcctgtgttctcctagatttcttcgtgcatttctggccactctttctcagcttcttttcccctgtctctttcacttctttctctgtattctgttaaataccagatttatttctctagctcagacctattctatgagctgaggtcttatagataaaattgaattattgatgtttttcactttcccaccataatgaatgatatgaccatccattctttcactgttcaaatgagaaatctcacacccgtctgtttcctctctcttctttaatgcccatatttaaattcaatccttcaatgtaccctatcaaatctatttcaaattgtaccccactaaattcatgtctatttccattgtcaaaagttgatccactctaaaattctccatttggaccgttatattagactcctgattgctgtttcgtctttctcttttgccgtctttcaatctattctctggaatctcaaagtaatcttttaaaaatataaatacaactaatgccactcattgtgtaatacctttcaatgacttactgttagatgcagagtacaatcctaactactaaacttgatacagtttggctggtatttttcgctcctcttttcttaagtaactctttcctcttttcattattccatagtcaccaacatttatgcaacttctcagcccatgaatattttcttcctgcattcacacatcttaattttaattagttcttagtttccctggctcttcctcatctttcaagtttcagatttagtaacacctcctcaaaaaggccttcctcactccctatcccattatgatccccaataggcatgattgtgtattttcttcacggtgcttcctaatttgtgaacatttatttgcttgtctatttcccttgttagaatataaattcctttgagggtagacaaacttacttttacctactacattatttaagtcctacagagtaggtgattattaatattcaccaaaagagtaaatgaatatatttttacatcaactcatgttgcagttaaattctgaagaaatcatcacagaaaatggtaagtaaaatcataacattttgttgagaaatatcgggggatagagtgctgatggggaggaccatcacggtagggtgctgctgaaggaaacaccaagtaagaagggtggatagaggggcctagcaggaataacagtagcagtctccatgagcatctacaatctcagattgaaatactgatggaagttattttggaaaataatttttgtttattaaaaccaaaaattgttaatggtaaaaaacaaaaatattaatggtgaaagatcttatttcagatggtctgtccagtaaaaaaaaatgtggaggataatcttttgaaacagataatctaataggcatagatacaaaaaataactgccattatagacatctcaactatctggatgcctgattgactcagcaaaaagcacagcatttaattacacctagaaccttgactcaggattataatacactggaagtggctacagaaaatctaggctgttattgaaattgaatcctctaggtgacttccctagtttttctctgttgtgcatatcaccttctaatatactaggtattttatttatctgactattgactgtcctgccttattgaatgtatgctccaagaaggcagaaacctttgtctattttgttaactttagtatctccttcacctagatagcaggggctcaataaacttttctttaatggacagaaataaaagtgactacaatattgtgctggaaataatgtgaaagtgtgggaaaaatacttccaaaatgcatatattctgagacttagatactacttctgggcattcaccctaggaaaataagtgagcaatacaaatatataaggatattcattgtgacacttctataataatagtgaataagacttaatcctcaataatggcagattcattaaacaaattctggaaattccatggaatgcaaacctaagcaaacaatgaaaatggtacagtggagatgtaaagatatgttacatatattgctcagggtaaattcagctcatatgacagaacagtctgtgtaatatgtataataatatacaatagagcatatatttgtgtgtgtgtatatacacacagtatttcatagactaaagcttgaaaggttatgcactacaatactgaaagtggttttcaagtggaattatgtgtgattattttccccttttgtgtgttttctaattttcctacaatgagtatgcatttttggatgaaaaaccaaaaggatatatggttttctaagagaaactttactccagaaattttataaatgactatgctgacatccaaaaatgttaaatgacatgctaaaggtcatgcagcattttaattttcctttcaaagagcatcaactctgagtaactgagaaaagaaataagggcttgaaactccaagcttaattctgattaccaagagaaaacatcatttaagcaaagggaagtttaggacaatcaggctatatgatttagaattttttccagctaagattagcacaacaaatgacaaaaataatattaaaaacaaagatagactcttaattggaaatggaattcagaatgagtagaaggctctgaaaatggaatatttgacattacaaatgtttcactaattagtaacaggaaagccaccctaaatacagcttggctacctagtgtgctctccaaagaactcttagtgtaactgggacctactagtgtggagggttgagtcataattcaggacaggtacatgaagatagccagggaggccaccaaactttaaaaaacttcaaacaacaacaagaagaaaccctatattcaaccaagaaaaagggaagtatgatgagtcagtttgattgcttagaatatgcatagtttcaaaaggaattttgggtgggtaagtgggaaggatgatgcagtttctccgctgcttccatgtttctcctcaataatgctcatctttaaattaggacgttgaggaaactgaaggcccaaatgttttttggcctcactaaactagaaactgttaaatgaagttgatttgagaaaactaaacaccaaaatatttttgctgacattaccaaactaaaaactgttaaatgacagtggtaatggctgtattccctgtgcccagctcaatggctgttggagagtaggtactccataaacatctgtgaaggagagtagaaatgtgaagattatcagaaaaagcaaaataatttaaccaattcatctgcattttccaaagaatttaaacttggaatgcaagaagaaaaacttgcaaattagattagattttataaaattaaggagatttggagagcatcagaagattgaaacataaacgtttttattatcaggatgcattgcatgaacaacagacaggtgaacctgacactaaaaccaggtaaaaattctagaaggcatatagttattttagaaacatcgtggaagaaaagtgtgatcataaggagattaccaacaagtcccaaaccctatttcatgttttgatagtgtcactaggttgataaattttataaatgcctttataatgtttctgcatttcagcaaggtctttgcctatcttagcaaagtctgtctttcagaaatccctcttattgtccaagaaaagaaatatggactgtatgaaaatggtattagcttagttcatgttgttctcttaaggtgactcccgcccaaaaatcattcagtttattttttgtgggttcatatttgagttctgacttgatcttttaaaagccttttagtgtttggaaattgaagaagtattaatctctgagtgtcactttctcgtttgaaaaacaaaaataccaacaaaactgcttaaggctgtcatgggatgaaagataaattatatgaaaatcttttgaaacctgtgtaacactgctcaaatacatgagtataattatcataattttcaagatagcactgttttcaagatggtagcttcagaaggtaaacagggtcaaaaagacagttttttttttgatatgaagatctgtacataagtgtagactgaggtatagaattcaggatagaggaagactgaaagtactggaaagaaagagggtcaggaacagagtcttgggagaaagtcagtagtagaaactattcattgatttctccaacatccttctttttgatataattgatggcattaggacttacattctgcggattcatatggtcctggaaaaattatacacaaaattatttgtatgatttgaacaactgttacttaaaggtgaagacattttattaatctaaattggcattacttatttatattattaaacaaattccatattattaagcaaattccaaactgctatgttctaaaagcttgtttccaccccacccccctgccaaattcatacgttgaaattgtaactcctaaaatgatattaggaagggcatcctttgggaagtgattaggttatgaggctggaggcctattgaaaggggttagtgtccttataaaatagctcattatcccctcccaccatgcgagaggacagctggaagatgccgtctatgaacaagaaggcaggacctcataagacacagaatctgccagtggcttgacttggacctcccaggctccagaactgtaagaaatagaaataaaataaaatgtttattgtttataagctacccagttgagagtattttgctgtagcagcccaaatgaactaagacacatatcttagacttccatttccatctttaaaatgggaagaaatttttttccaactaaatatttgctatgtttaaagcagatgataatattagaagtccattctagaaactctgagtatttggatataaaagcagtgttgcaccatgtcccattttatttgtatctttgattgtggcaattaacaacctgctttgtcatatcctacaaaaaaataacagttgtcaattgagatatttggttgtgactttatatagacctgtgtgtgtgtgtgtgtgtgtgtgtgtgtgtagttttctttatttttctgtctgaactttacatttagtatattccagtacagtggtgaccttgacttattccggatgagatcagggctaaattctactattttgtaaagtaccccaccaagttttgtagaaagccttataaatatctccaaacaacattattttgaataggaaatgaaggagagcttttcccagaggaatatacagtgttttcatttcagcaacattgaattgccactgcacatagccccatggccttgagtaagtaactgactcaatatgatgctattttgagaacatgactttataatgacttcatgctatgtgtatcatgtttccattcagaatggaatagattcagtttaaatatctatcccacaaatgtttatgatagcaactaactgcaattggctgcatttttttctggccataaaatttgagggtttagccatagatacagatttaccataaactaatttctttactacaattgatagaattgaggttttttttttaatattgcatgcagtttattaaaatgttaagaggctgagtctttagtaaatctccatttaatgtacttttccagtggtatactatgtttgtattattcagaatgtcctggttcagcaatagagtttatagctagatgagattacaggctgataacacccagatagagtttggacagtaggagataactatttatcacatcaggcaaataaaatggaaactggctctccgctacttcctttcccccctgactttaaaaaaaaatttttagctgcacaatttaaaatagaaaaaggctgtcccaataaaaacacatttttgtatttatttgatagtgaattgaaatacagcaacttttaagaaaaaagaagtcctgagtagtttcacgcataaacattccttttggtaaaatgttatttatttttaatttgagagataatagtaacaaatcagacgtgtttaaagcaacaaaatagtaacagtaacaacaaaacattgtaaaagaggctatgagtcaatactaactaaagattaaattacatatgacatttgggaaatgaggaccaaacagcttactttttgtatatatgcaaactgtatgggtcatatcacttctaaattaggaaaaatgtgtatgcctatctctcatgtgtttttactattaagacagaggtattctgccaccatagaaagatccatcaaagtctatgcaatcaaccaaacttagacttgaatccagtcctacttataattgtttggcttgggaaaagatacttaatttttctcaagtcttgacttcacgaaattacaggtttgtaccttaggaaatgttgactgatgttaaaatgatataatgaatataaataacttagtacagttcctgtcaaacaaaatacctcattacttagtaaatgtcataactgtacttataaagatcacagattaaactaagcatcaacctgacagtgttaacttttatattgttagattagattagaatttgtattattaaatttcgtattcatgatctccacatctaaataagagtacacattataacatgctctagtcacacggatttatgtgttgaccctaaacatatctcttcacttatgcttttctttctttcctccctacttttgaccaatatcttttgtctgccaataatactcttcccctgtctttgtgtctgcctttcaaaggcctgtgctctgcatttatgaaaaccccgatgaaccactatattttccatgaagctttttagaaaacacttctaaaataaacctgtccctctctgccattcctacagtatttgtcattttatttaacttctgaagctatttatgaaatattcgtcctattggactgtgagttgctggcatcaaaatacatttactgtactctattttgcattatccatagcttataacacagtctcatgtattcagtacatttattaataagggcttagcagcccttattatatttatatattcaatacatttattaataagggctaagaagtcaggaaatattctaggattaaagtttaaacaatgggaaaaattgataaaagactgaggaagggctggtcagaaagatagaagagaagccatagtatagtgtgtcccagagagaaagagaacttcaaggagttggaggaggtcaacacgctaaattgacaaccactccgatttttcttgaactcattctattgatatccaaatggtggaaaaatgataaactgctatgttcctttaggttgattccacggcatttattgagttgaagcctttaatcctgtaaactacactcaggattctagttctgaccttgaaaagcccacacctagtcacgtagttagggagaacctgctgtttgccagataatggtggtaaaaaaaggtattcaagatagtaatcattctttattcctgccattataaagtgaacgtcctgattgctgagggtgatgaggataactgattgaacatttacagtgcgttaagtagcaggctaagtactttacatattttttttattttattctcacatttctatgagaaggtgttctacaaaaacaaaatggaggcatgaaaaagcgaaacaatattgaattgctacaatatgctggaaaaaggtaaaataagtccaattatcttctgctttacatcccttccaattgtttagaacacctgccatatcttttaagtactgtcttctatagaagaactatttccaggttcatcagccattttttttaatgaaaaagtttccaggctttttgctttctggataaatttatcggaatatggtaatgtggacaaaaacctcttttaaaacatttttggaggtagttttccaagcacaatagaataatcagctttcttactgtagcaacttcagttctactgacattacattcagctttttgataggtacagatactattgagagatttacaaaaaaaaatcataaaaacctctagatattttcatatgaagtgaaattatgtcatcttgcccttggatataaagtattttgaggtaattctttctttagatccaggagatataataaaatgatactgaaagtatagatttagaagggaacttatgtaacatacggctcttagcatggtgcgcagaatggaaatattcaatcaatgtcagcttctcttcctattagctttgtgctctagagatgaggaaactgagctcagctttctcattttcaaccattaacttcatgctttataacacaatatgtgaacttacagtatctttggttttcttaatctgaacataattaaaaccccttggctttttgaacttctggttaatcctaatgtgagactgtcagacaccagtattttggttcttccattctgtcccaatcttgtttatttgacctctttctataatgtaaagtgtcattttccaacaagatttcatatgaaaatcctctattaccacacactttctttagaggctctgctcctttcttacttatcagaattttctaattaccaggatttaattttgtgcatatctacaaaaagccaccttcctttttaacagcactgtctagagccattattcttatatttgctctgaaatgtcttatatctactctcctaaaatgtggaatttatcacccttatcagtgattcctttctggatgatataaattcagaaaagaaacatacttttcccctgttgtttggtaaatacaagcaagttgctttagtatcatagaatagagtaattcttcctgtgagagatggaatgtacgcaggacaagtcaggaaatgaacacattttttataacaataaaagtatccaaaagcaacccgaatagtagctctccccttattacatcttgatactgtcagctgagtgatctgtattaggacaatatcactgtgtcctccatctagctggacagcctataatatactaccacaagaataacaccacactttctcctttcatcatcatccaaatgttactctgcttttttccacctacagattcttggatattttacaagcatttatcttattgacaaacagggctattccacacttacttttagactggtttctttttgatgaagaaaatccttctattgtcataaaaatttattactgggactgatacatatttttcaaatgtgaggagggaaaccatataccagcattaaagcacatctttaaatctgtttatgggtaaaataacagtatcatgtttcttgcagaaaaactccctcatggcttatttctcaccccttcacctaaatggaatagctgtttatgttgatgttctaactattctgctgtggctggtcttcacctatggaagcttagactcagtgtcatatctgaaaactaataacagaaaattagtcaaactaccttcctatcagaaaatatacatacagttatgtagatgcttggtaaaatgttattatactatttaggttcttatccttaatgttccaaaattctgtgagtccgtgattctagcatgtgagagagacaacatatgtttcatttgatgttgcagacattttatctaaacaaaaactattgacttcatcaattcaagttttgtttattctaggacagttttgccctttcaaacctgtgttttcaggtatttaaggaaatgaggagttagatttgaaactattgcagttgttcatagtagaggaagtagtagtagtagtagtaatagtagtgaatgcatccaaggtcaggtgacgtttcctagaagatttttatgcattttctcctgtgctcccatcaggcctgcaagaataaccaaacacaagtccaaccactggctgcttgcagaatccaattaacaagagtgagttatggtagaaagaaagtgactttatttaccaaaactagtaatggggaagtggccagatttacatctaaagtaatcacttcaaagtttaggctggagagaggggctttaaagggggaatttggagtggaaggcatgagggaaaggtactcagtacaaggtctgcatatcttgttctggtggctatttctagctgtggtcctccgggagtgtggactgggattatctcaacaatagctgggttgctgactaactgccttgaggtaatctctggaattttgcagctgggtctccatgcatggtctgtttcaaggttatcccctggaacttctaagtaagctcataattagtacaggcatacggttaaataaatgtgcatggtttaagggagtgtatggtaagaaagagagggatgtggtgcttcaaagaaagtacatttaaaagctagaacaaatagacttaacagatatttacagaacattctacccaaaaactgcagaatatacattctatttatcagcacatgaaactttctccaagatagaccatatgacaggccacaaaacaattctcaataaatttaggaaaattgaaatcatatcaagtactctttcagaccacagtggaattaatttggaaatgaactaccaaaagaaccttcaaaactatgcaaatacatggaaattaaataacctgctcctgaatgttaattgggtcaacaatgaaatctagatggaaattaaaaaattctttgaactgaatgataatagtgacacaacctatcaaaacttctgggacacagcaagtgtggtgctaagagcaaatttcatagccttaaatacctgcatcaaagtctgaaagagcacaaatggacaatctaagctcacacctgaaagaactagagaaagaagaataaaccaaacccaaacccagtggaagaaaagaaataaccaagatcagagaagaaccaaatgaaattgaaacaataaaaaatgcaaaagataaatgaaacaaaaagcttgttctttgaaataaataaataaaattgatagaccattaacaagattaaccaagaaaaaagagaaagccaaataaactcaattagaaacaaagtaggagattaatagcagaaatttgctggagcattatggtgtagggaactaaaaggttctgagaaagtctgtcctcaaccctatgcagtgtacagtggcaataaaatccttagcaaccaagttaaacaatgagcagaataccagttatattgtatatgagagtcttatctgtattaagaagttaactaaactatgttgttatggagtcctgagaaaagacatctataacagaaatacgagtatctaatgcacgcataaatatatatatatatatatatatatatatatatatatatatatatatatattctctcacaatataacccatatatatgtacacacacacacacagacacacacacacacacacacacacacacacacacacagatgggatggagactcaatatttaatgtattatattaggcctcatgagtcaaaaggtctttttaggatataaaggcatgcaaatgtgcactttctgtaaactgggcagaactagtccatggttggtggtcttttctcgggagaaacttactggaattaatattttatttaattaaagctacagttgcttgtgcaataaggggctgtggggcagttaacttattgactgctagagaaaaagaaaaaacatatggcagttagaacatagagaaaaagaaaaaccatatggcagttagaacatagtttattctttaagtgtaggagcctgtgacttacccctgcctggcatggtcttaggtcctgtttataattttgtgttttgttacaacaagccttttctgtcaaccttatgatctccattttaatgttaatgctgatcagttgtgtctaaatcaaaaaaagtgaggaaaggtatagtgaaacttgtctgactcttttcttgctgtcatggcctgaactggttttttaggtttctttgggatttcctttagccaagataaggggtccattcagtctgctgggggacttagaattaatttattttttgtttatattctcccttttttgtcaaagtataccagaggcagtgctgatggccaaccttctattttgtcccatatcaatgctgaggtggtgtgatacctgcccctggtccatcatacaccttggtggaatccttatggccaaggaccttagagtcaaaagaattaaagccaattaaatgctctaagcaagacaggcatgaaggtgggaaggcactcattaatccttaaaacccttttaatcaatataataggcaaaatccagaagccaaaaaataaggtcataaagtggacttatctataaattctgtgcatttagctactgtgatgtgatcttggcttgtagaaattagctgtccaaaacacaaatagtttgttcagctgtttaggcatctgtgtgcccatccctgacttggagggtctgaataaatttgtatagctttgataagccccagctataaatgagagacttaatttaggatttgatcttcaagatgtttgtcaaagatgttaaaaggctcaaaatatattattgcaacagaaacataggtcattgtaaaacaatagttactcatttaacccaagtaataatcaaaagactttaaaggcaatacaggaggttacatagatgtaaaacattaattcttttaaatatcagttttttaaggaattaaaaacctaataaagagtataggaattattttgataaaacctaaaatgttgtctcttaagcgagttatcagaaaggcaaagaaaaacctgcaatgtgactgcttcttatgggaagcccatttacataacctgaaaattaaatctgatgaaaaagtacttgaatttaatcagacatcagaagattgtgttaagattatgagtatagcaggggaatatataattcttagtaactgcataagaagttttctgattacattcaaaaatttagacatatcaagaaaagccaagatgacaaaatcaggttatactggaggaaaacattgcttttctagaccctcgagataaaatgttttcacatcaggccacaacaatagttacaactggaggaaaaaacttacagaagctgatgaaaaagctgaaggaaagagtcacctcaagctttctcaaggagagaaaaagctaaaaacagtgtgacaccacagaagctgaacttctgaggtatgattctgagaagttttcaaaacaggatataaaattaaaaatcaaaatctgaattttattaagagccaattaatatcttaagaaaatctcattataacacaggggaccaatcttataaagaccattataactagttcccttctaattatagtcaactgaattatatacaaaacttcttttataatttttctttcatgaaccttgtcacagcttacatagaccatttatgacatgcttggactttctgacttgtattacattttcctcttttctacataaccagtaattttattttaagacaagaatttatcattcatataaactcttttttcatataaaattattatcttttctttataacctttttatttaaaatatattttatattgataactttctttatatctctctcccctgcttactggtttatttttaccttttttaaataagtaactttaaaataacctccaaattatataaaagtattcttttttaacataagaatacaacttacagaattatatattaactagaattattaattttagtaaccttcaattttagtaaaaatttagggggtaagaaatcctgaactatttgtcagatgttagcattttatagattaagccattccactattttagaaacaattttcctacatcataatattttcttaattgggaatgactgagacatccaaggagcacttattatttaattcaaaataattttaagatttaaaattatacaaaaagtacacttacaagtatttatgtcattaacatgtactcaatttttccatttttaccagttgatctagattacttttgaaaactgtcatattacacaaagctagtcattatttaaagttatttccctgttaaccatttttaaaatctgaacattaggtgaacacctaagtaagaaacttaagcacgtgtgtattttgctgataactcagaagattcagctgtttttattgaaccaacaatcataaattagtcttatttgtaaaaaaaaaaaaaaaaaaaactcatatacacaaagattactctgtttttggctgggtctcacaacctttatgccaaaacattgataccttaaacatttagcaaaggcaaatataaaacttatttatccagacacaaatgtatgcccatgcttccaaaggcattttttaaaattttattaataattatagttagaaactagttttatttatcaaagattcatgtgaatgaaaagcatttggacttaatttatgagtactcatttacttataagccaatttggtagcatactaaatatgaaacagaacataatacatgtatattacataaatacatctaatcgcatgtatacatgtgtgcacaaagatccaatagcttttaccttggaactctagccatgagatagcatcacaaactcattgacttataaaagatagctggctccaagttatttttctgacaaaattggaacctcttcacatagctaaactttgtttgccctgataggtaatccaaggaaagttttgaaccaaaattttaagtaaagcagcctctatggcaatttgtggggtttttttaaacttgagaaaaaaaactcttttaccttttttttccttttcagtttcaaacaagtttccaatgtttacattctagatagaccataagtaatgagtcttagcaccagcagcttagtaacagcagatttaaagcaggtagaaagaaaacaagatagagagctttagaagattccacttaactctctagttacagattcaccatttgagctctgaatttttcttgctttaatttgtctgtcagttcaaaatgggcataaaataggccatactatgtaaccagctggagtcttaaagaggatgacaaactcgggctaagatgttggaagctgtttttccccttcagggctggtgtccctggattgaataagaaaagcgaaaaagaaaggaatggagagaagaaaggaggtcaggttttacagaagagaggatgaaagagaaaggtaggagaagaagcttttgagccacctcaaggttcagggtcagtaccccccaccatcctactttatctcctgtcagagagagcctcagcaccccacacctacatggtatggggtgaatccctctcatctctgcaagtcaccagttaaggtgaactatttccaggtggagggagctaaggatgcttttggcccaaaggagtaaggctgtaggtggctcctgagataatctggagaatgaagttggaagaaggggaaagagagagagtagggcccacacacaaaggtcacacactcacacatacaaacaagtggcatacctccaaaaaatccccaggtaaagggctgggtagattcccaaatgtatcacctcagtttcaaacagtccccccacccccaaaagtcagctgagtctgaaccaaccaaaaccccaagggtaccacaaatacaaacaaatacaaatgcataaaacactcaaatggtatccctagcagccgagtctaaatagagaagagccccagtgacaacctaaaagaggcagaggatagttgagtgcattccaactaactcacttagttccaaagtttgttgacttctccagtggtcactttctttgcaccagagaagcattgaaggcagcaggcactgcagcaggaagagaaagaggatccacaagacaaaagcatcttggcagctgcagagaaattccctaacgttccagccatggggtcagccatgagcagccagcattcacaggcatccctatgccccatcatacagaaattagactggcaggctggagactccggagcacacagcaatccccatatgggccaccaaaattgtaactaaatgcagatctggccacttgctgcttgcagagcccagtaacaagagtgaggtataataaaaactaagtgaatttatttactaaaactaataatggagaagtagccacattcacatccaaagtaaccacttcatacgttagggataggggtttaaaaagaggaacttggaatgggaggcatgtgggaagggtactgagtacgaggtctgtatatcttgtcccagtggctgtttctagccatgatcctcctgaaatgcaggctggcatcatctcagcaatagccagattgatgataacagccttcatgtaatctctggaaacttgcagatgggtctctaggcatggtctgttttaaggctagcacctgggacttctaaataagctgataatgagtaaaagtatacagttagataaatgtgcatggtgtaagggagtgtatggtgagagaggcatgtggtgtttcaaagaaagtatatttcaaggctatagcttaagactaaagaggagaagaaaaggtttccacaatatgcttaagggttacattttgagactagggaaaaaagggaaaagggggaaaagttttaaaatgcacttttaggctagactctttagcctaaaacaatgacattattattcccatttcacaggtaacaaaacaggttaaatttattattcatacacttaacaaatattgaacatcttgtatgagctaggctttattctagaaatttggtattactaattttaaaatggataaaattcctatcctcgtggactgacattctaataagaaacttctcatttattacaagacataagaaattagtaattaaaattatatgttagaacttgatacattctttagaaaaaagaaaaggtagaacagtgtaaggaagatctgactgctggagtgacagcagggaaagtgtagcaatattactcatgtcatgtttctggcttaaattctactttatctgcaacaggattccatccctgccttcctgtgtattatcttgtctgttaaacctttgctcattcctttatgtttagctttttgaatcattgtgttccaagtttgtcttttttttttctttttttcttcttcttattatttttttgagacagagtcttgctctcttgcccgggctggagtgcagtggttcaattttggctcactgcaacctccacctcacaggttcaagcgattcttgtgccccagtctcctgagtagctgggattacgggtatgcaccaccacacccagctaatttttgtatttttaatagagacagtttccccatgatggccagactggtcttgagctcctggcctcaagtgatccacatccctcagcctcccaaaatgctaggattacaggcataagccactgcacctggccaagtttttcctttgtgtatagcatagaattcagttttgctttataagccaaattgaaattttattattattattaaatgaatacatcctaatcacatttaggatgtgactaatatgttgggtctcaattgtcatggtatcttatgttgtaattactgaatatattatttttactgtgttttccccccactatgttgtgtttttgttgttgtttacatcatttaacttgtttatactacattttaacttgtttatactatatatttatactatatttatgaagatttctattccagctctagtggttatttttggtttaatattttatatagtaatcttaatttttctgtttctgttttctccattttaaaatttttacaatctcttctgtcaattttaattggtatctttcaaatcctatctaagacatggacaatagttaatgaaatgattctactttcctttctccttttccatgttttcttttttaagttttatttttgtgagaatatattatgtttacatattattcttttacccaagattaagactttgtagtctcagttctttgtcttaggtctgctagtaaaaatatgaaatacccccagtcctttggtcagacttggttggatgaagctcatcctctagcagattcctttgaaaggacacataagtgtgtgttttgcacattcaaaacttttttctattcctttcacacttcaaggacttagctgatgtcagaatttctaaatttcttgaaacttctgcttcatgttggttttatttttgagaggtctgattgcctgtctattctcatgcttttgtaccttgtcatttcatttcctggagaccctgaggatactttatgtttttttaagtctaatagttttacttgagtatggtttggaattgctcacaccagttcaattttccttaatacatcctttcaagatgcagattcaggtcttcttttgttttctggaaagtttccttgacctatagttttaaatattagttctctttcatggttttggttttcttagtgaaaggctccagatatgcaaatctcggacatcctttacttagcttccatttcaagcatcttctctctgaccctttttcttttatttttttttaaataaaaatgtcatttacattaccctggttgtttttctctttattcaataccctttataaaattgtcatttgaattcatatttttggtcattttgtaacttacttttcaattctgatatttaatttttttatttctttcttgggttcaattgattctcattttatttcttcctgtttttgtcctttgctgctttcagtgtttatctttctaattcagcatactttgaaaaaatttccaaatgctcatttgaggatatttaatttagtttgggggattgtattataggtctcttaagttctttggttggttttatgggaaaaattttcatcagctgaaatgcgtcaattcaatttaagtgatttttcaaaatagttgtgtgtggatgtggtctgattttttttctatggctatactcttcataaattgagagtgcccacttctttcagttcagcccaaatctgtgtaatttcttttatgaatggtgttttgattgcagtgttgtgggcggagggattggagtgttttattcctttttgttttctttgtttctttcctttccaacttcatacatctgacttcccccttccatctactgtcaataactccctgctgttgccacttctggcaccacttactttcgctaaacccagtgttaggaaccaccaagttctgacctgtgttcagcattttggtatttgtattgaactttctcactttgatgatgattttgtttgtgttttatctaattcatctagaatcctactcttttttagttcttaagtttcctctccttctttctccacacccacaggcaatggaaatacttcctagtgctcctggatgtgtgaatcatctgtggttttgtttgttccccttgttggttttatagttttttgggagaaggatcaatggggagattcaagctcaggacgccaaccttgttctccaagcctataggtctttaagatctggaggtgaacagagaagatgttaatgagaaagttatattaaacaaagccttgaaaaggattagaaagttgtgcagtgggatattggatggggatgcatttcaggcagaggaaacagcatgatggtcttgaggtgtaagcatctctggcatgtttgcggaacagaaatgaggggagctggactatggatgtgcaggtgaatatggaaaagaagagtaagatgaaaggtcagagaagtaagagggtgatgtgtatttgtaaggactgaataaacatgcctgaagatagaaattggagaaggtggtattcaaatctatctacatgatttcacaccttgtgttcttttcacaacataatgttgcaattcataaagagattttattaagttaacctataatgaaatataacccagaatatgcagttttggagctcacaaaagaatcttctagtgtgagagaatgataggtctttgtggactcaatttattatctctagtatttacctttcccttgaagagaactgataaaactcctggtgtcatgaagcttacattccatggagggagatacacaagaaacaatatgtaagtaaaagacacagtatgttatggtgatcattattaaacaggaaagaaggataacgagtgctggagagatgttcagaattttaggcaagacagctatgaaagagcttactgaaaaagtgacatttgaatgaaaatcctggaagatgtgagttagtgcaaggtgcttaatcattttgtacctaattttctcatctgtaatttggggaaggattacattaaatggtccatgtcaaagtatttccctatacagtagtaggtaatgggtgctctttgcatagctgtcttttcaatgtccaggtttaaagttagtaccacagaatattgtgttagggactctccagcagagtgtaaatgcttgagcatgtgcgcacatgcgtgcacacacacacacacacgacattgccgcttcattctggcaaagatcattttggtctctgattaaacattccagtatatcacctgtggaggtagactcctgcagacacattaaagcaagttttcattagcaattagaaaacatcagattccacaggtgccacataaatttgccagtttatcttaattcatcaactgctgtcagcatccatggctcaagctccccatcataaacaaaaaatgaggaagaaaagtttatgttttattcattcagtactaatttgcatgtggtttgattagaaagtaaagcaatgcagtcagtagatggtgccagagggttgcttttcactgcaaggctagaattagtttgctgaagataatcttttgtccaatgattctgattccttttccctggccatgctaaacatttttcacacgggtgaactattaacataagaaaaatctaaaactttagagtatatccacattactatgcatggaataaatcattatacatcttattaaaatatttaaatgtataaatttcaaaagaggaaaatatttaattctcatgttttctaatcataaaaaggatgtcttaagcattttgatgaaattattaatatattatttgaatttatattcaatgcattaagttgaattatgaatatgtatgtgtattatttatatatgtatatataaaatttaaataatactataatatcttaacaaaagtgatacagggaacacatggtggttccatctacctatctgagaagattttctcaccaaatcttttggagttgtttcttctggagggaaaatgatagtcttatttatctatcatccctttaagcataacaccacatggtgctcattcatagagtaaatatttgttaaatgaatttctcacagtgatatcttattctcaagacctccctccctttgtgttatttttataaaaagcttattaatcatattcactcatttattaggttcacataaggattgcatatgttgtcaccaaaactcttctataaatcccttcaggttatagaccatgttaatctttaactttctaaaatttatttaaatcttctcccattttttaggttgcctgttcactctgatggtagtttcttttgctgtgcagaagctcttcagtttaattagatcccatttgtcaactttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcgggtttgtcaaggatcagatagttgtagatatgcggcgttatttctgagggctctgttctgttccattgatctatatctctgttttggtaccagtaccatgctgttttggttcctgtagccttgtagtatagtttgaagtcaggtagtgtgatgcctccagctttgttcttttggcttaggattgacttggtgatgtgggctcttttttggttgcatatgaactttaaagtagttttttccaattctgtgacgaaagtcattggtagcttgatggggatggcattgaatctataaattaccttgggcagtatggccattttcatgatattgattcttcctacccatgagcatggaatgttcttccatttctttgtatcctcttttatttcattgagcagtgctttgtagttctccttgaagaggtccttcacatcccttgtaagttggattcctaggtattttattctctttgaagcaattgtgaatgggagttcactcatgatttggctctctgtttttctgttattggtgtataagagtgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgagtaccctttatttccttctcctgcctaattgccctggagaaaatttttgcaacctactcatctgacaaagggctaatatccagaatctacaatgaactcaaacaaatttacaagaaaaaaacaaacaaccccatcaaaaagtaggcgaaagacgtgaaaagacacttctcaaaagaagacatttatgcagccaaaaaacacatgaaaaaatgctcaccatcactggccatcagagaaatgcaaataaaaaccacaatgagataccatctcacaccagttagaatggcaaacattaaaaagtcaggaaacaacaggtgctggagaggatgtggagaaataggagcacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaatgatgagttcgtgtcctttgtagggacgtggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtgggggtagcggggaaggatagctttaggagatatacctaatgctaaatgatgagttaatgggtgcagcacaccagcatggcacatgtatgcatatgtaactaacctgcacattgtgcacatgtaccctaaaacttaaagtataataataataaaattaaaaaaattaaaataaaataaaatttatttagaccaatgcctggcaataaggatagcatgatatgaatgccataactatgaataatacagttaatatagttaataattatactataattaataacttgtatggaaccacaatattaaatttcttatttctaggcacaagcagtgaagataaaatacttatgactaaattcaatcctaattatgagacaaatagggaaatttgctgaaacacagaaatttacttcaacctccaggttttggcagcaattaaatttagagatagaggcaaatgttttccatagaataaacacagcatttgaatttatttgatcttgaaaagtttaaagtgtcaaaaataagtaacagaatacataaatatgtcatttgatatactttacagactttggaattgacaaaagttaaggtgctgatcaaaaattatgacaatttcataaaacgtgttatatgaaaaaaacttaagagaaatagacttttgagagaaagttgaggaaataaagataattattgaattagatttggagcaaagtaggtaatgtattgagccaattgttggaaaggaacaggatgtcagattctgtagataaagcctgtgaaagaaaagagcagatcaattggattaggataatttaaaagagtagaaaaaacgtccaaatatcttgaatctgagaaaatgagaatatttctacaagtctttgcatagtaaagatcttagaatcttttgccagaatcctcacatttttatttgacatgaaaattgaacatattattaaatccaaaggcctaaaatgtctcataaggattccagtcccctgtgattgcacataggaatctcaagtgtaagacactttgctgtcaaatgtgtttctacaagtaggcacagcactggactataattgtaagaggagggtaaaaatataaatctcttcttccaaagaaacttttgttatcaaacttagcattttaaatcaatcagtctgatacctaaaaacttagaaattatctctctattataaggtttgctgttctaatagtaagcgtaatagatactatatttgatgattccatcacttcgattggtatgattttagttaaatgattgcactattatttatgccacaggatgttcagaacccctgatagtctctttgatactcactgagtaatgatagttttatgctgctatggccttagagtaacttcacccaggaaagtattatagcaatcccctttcaataacttttacaacaagtgaacatatttattcctatgtccctatctgtgcttagatcccatttttaaaatggctctttattagacatgtgtgttttttcatctgaataaatccttgtaaacaacagtgagttaggttttataaccccacattatgaatctaaaacaggctgtataatatgtttaagtccataaagggagtaagaggtaaggctatgattcaattcttggtctgcttaccaccaaaacttttgtccaatctgtctctggggcccatgtattctggttgtctgggacagttctgattgttgcctatccggcttagcatttgtcctcttctgaaatgtctcatttggatgataaattttatggtcactctagaccacactaagaaaccaggattatttaatcaagattcagacattgcatcaatgtactggaaaactagaaatatggtttctactttaaatgcttaaagaaaaatagagaacttggacatctattcaagttaatgtctccaggatacttgcataaatctcactgtgtataccagttagtccaatgctaaaaacaacaaacaaacgaatgggttatgaaacttgagagtgcgtaccagagtataatattagaaatttatgcatgctgtacacatgctttctttagaaagaatttgtccctgggtaagattgattaataaaactactcttcttcagctgctttaaattatatgccactttttaaaaaaccaatattcaacaaaataggttatttctagtcaaaagagttctaagaaaatatcaacatatttatctctacataaatatagacaagctgaggatgagggcaaaaagcacctacatggcccatagagctacacatgcaatgcacgtacacacacacacattctggacctcacctcctacctttcttttgctcattctgtttcagccacagtcagtagcttccttgctttcctgaagcatattaagctcccttctctcatagggcctttgcaatttccagtccctctatttggtatacttttccctctcatttcccaatggcttccttccttccttcaggtctttgccaaaatgtcatcttctagtagagatctctgattaattaaatttaaacagcaaaagccccattaccacacatcttacttttccccattcctccataaaacatacctcctgacatacctccataaaacagaccttctaacatacctccataaaacagaccttctaacatacctccataaaacagaccttctaacatacctccataaaataaggtgtgttagaatgtgtaagttctatggagaatattaaagtaaaaatattttaacttttttatcttaatattctctaatataaagtatttttactttaatattctccatagaacttacaccttctaacataccttattttatacttatttatttcacttattctctgtctgccgctctgaaaggtaagcccattgagaacaaggtttgtattttgttttttggtggtggtggtggtttgttttgttttaatttttgtggatacgtagtatatgtatatataaacacacacacacaaatatatatatacacacatagtagatatccacaaaaatatatacatatatgttacatatatatagtgtatatatgtatccacaaaaattaacacaaaagaagccaccatcaccaacatgtacatgtataaaattaaaacaaaacaaaccaccaccaccaacgtatatgtatatctcatgttccatatatatatatatatatatatatatatatatatatatatatatcatgtaccacatataggtatgctacatgagatattttgatacagacatatgatgtgtaataatcacatcagggtaaatgggatatccgtccactcaagcatttatcattttattgtattacaaacaatccaattattctgttacttatttttaaatgtgcaattaattaatgttgactgtagtcatcctgttgtgttaccaaatactagctcttattcattctaactattttctgtacccattaatcatccccacttcctaccaccactgctctttccctgcctctggtaactatccttctactttacatctccaggagttcaattgttttaatatttagctccacaaataagtgaggacatacaacatttatctttctgtgcctggcttatgtcacttaatgtaatgacctcaagttccatctatgttgttgcaaaaacaggatctcatttttatttgtgactaaattgtacttcattgtgtgtatgtaccacattttctttattcattcatctgtttatgggctcttcagctgcttccaaatcttggctattgtgaatagtgctgcagtaaacaagagaatacagctatctcttcgatataccaatttcctttctttttgggtatatatacctagcggtgggattgctggatcatatggtgggggtgggtctattttcagttttttggggaacctccaaactgttcttcatagtggattgttctaatttatattctcaccaacagtgcacgaagttttcctttctgctacatgctcaccaggattcattattgcctagcttttgggtaaaagtcattttgactggagtgagacaatatctcattgtagttttgatttgcatttctctgaagatcagtgatgtggagcacattttcatatgctgtttcccatttgtatgtcttcttttgagaaatgtctattcagatcttttgcccctttttaaatcagattattagggttttttttttgtttttgtcttgttttgttttgttttttgttgttgtttttttgagtcagagtctccctctgttgcccaagctggagtgcagtggtgcaatctcggctcactgtaactgctgccttccaggttcaagtgattctcctgcctcagcctcccaagtaattgagactacaggtgcacatcaccatgcgcagctaattgttgtatttttagtagagacggggttttgccatgttggccaggctggtctcaaactcctgacctcaagtgatccaccagccttggcctcccaatgtgccagaattacagacatgcaccacggccaaggattattagatttttttttcctatggagtcgtttgagctccttatattctgatgataatcccttgtcaaatggattttttgtttcaatttagtggggaagtgtttggggtctttttactgaaatatataccacagtgtctgccatactgtatatcctcaatgaatataacttgacaaatagaatgaaaaaatagattgtgaataagctgaatttcagcttagagatgacaatttgtctcaatcgctggaagtatgtttcagaaattaagagtaggatcccctgaatcagcaaccttgtttagttacttttaagatcttatgcattacggagaaccagcgatggttaataccttatggcatatatctcaccacagctgaaaatgatgctacctactcgaaatgaatttcataatttgcatctttctcacagttacagaaggatatagaaggtaagttcataatcaaagtcagttattttttgtttgttttgttttgtttttatatgcaagaggacatatttgcagtataactgattataaaagtacaagactggtttttaccctgattgagggcacagctcaatttccttttagttataccatgtgtctttgtagagctgattctgcaggccccaagacaagtccctttctcatattattgaggttctcctttgattgacaagtattgatcagcaactcttttggcaaccttgaaaaatagttgtcttcttgaaatagggttttctacttataggaatatgaccagactcacttaaattaatccataaagatggaaatatagagagaaataatatacctgactgattactgactatgagttaggcatactcagtcctcattcacaccttatgagatgagatatttgtattctgattttataacaagaaaaccagagtttcagaatccaggttcatgatgtttggtaaatagtgagcattcacaaagtgttaagtgcctttatttgtttcaccacctcttccaggtccaacattttattatcatacttgaaaagttaatacaaacataccaagttacccaaaattgagtgtagatttcttgataattagagtaattgttaaagttaaagcattatctacctgagataaatatacttgaaatatatataaaatgagaaaaaatatattttaaaatgcattgggtttaagaagccatatgagataaaacaattggctattttcccattaaatatccaaagtagcctggaaattttctattttgtgagattatgattattataattttatagctggaatcatgctaaaacacatgggacaatggaaaaaatgttttatgaggcaaaatgagctcactttaagcagatgattcagattttatataatgataaaaatttatttcaaagcccacattacatgagtataagaaatttcagctgctgacactgtaaagattgttttcattttacttttaaaacagaccaaaattctgtaggcttccacagatctagtgaatagtaacaaatccagaaattgctgttctgttgcagtggcaatttccttttcaaattgcctaataataggtgttggatttttctccatctcctgtaccgtttaaaaaccatccggaactgtgtctggtatgtagtagttgcttgtttagtatttgtccatttatcaaattagttttcttttactaaaaaacaaaggaatgtgctttcaaggtaaaaatttccacaactcaatagaattgcagttaaaagaaagcttctcttccttcccagaatccaagtcttactctcaaccgaaactggttatggttttttagaatatttcttgttggggctgacagaaagcactcatgtgcatacctttctcctcaaacagtgcattagtaaaggggctttctagatatacgttaccaagttcaaagagaataggaaagcatccatctgcagatgaataccttcagtagatttctacaagataaaactttggtggaagaaagtcgagtgaaaaaacaaatcagagaaagaacactctaatagaagtgcaaagaggccacttgaggaagtcttctctaaaactggggggataaatcaagaaagaagatgggagatccaggaaactgtggacctagctctagatgagatgttgcaacagggctacagagctgtcagtcctgattggagtagattccaccaagtcaatcagtgggctggaggagggaggatttcaggagatagttcaccgtttgatatagattgctgtccttttactttgttaagtacacctatgagaaacaaaaatgaaatcctaagcctgccaactgactgaatggattctgtcttggtcaaggggatctcagggaaagcttggaagttgagttcccagcaataacaggatgggaggttggacaccatctcccatgtgcaatgaaagttttcatgtcccttgcttcaccttttgacaccacagggctgaaaactgtatcctcgaattatgctaacccatttttggaacatgggtcccatagagagacatgaaactcaactgcacatgcccacatttctctacttataaatattcatgactcttcctatagtttattgaatatgtgtatttggccagtctattcaacataaatccctgtcatattcttctgaccctcaaaaagtgtgtttctggcttctggatggaggttacacttcctggcctctcagaatggctacgctgcaggctgcaacctttatgaaaagtaaagctctcctttccaaatttatgaaatttatcattcttcagttgatacatctttttaaatttatgaattgtatctccctcttaaaattagaaaggtgtatgcataggaaattgtggataaactctgtagttttagaaacagcagtaagtgtgctgaggaacaactgagtcatcagtactagtgatcccatagaacacggttccaacagtttgtgtaagatgatggatagacagatagcctgagtggaaaactgacaatccagagctgatggtctctctgcttggagatgaagcctcttcgtatatgagcttacacttataaaaagatataaataaggaaaagtgaagtaaaagaaaaacccatgttgatactctgtggctagaatttgtcatatatggtgttgagagaagaggggacgtattgaaagaggaattggggtagggaaaaaggagggaactacatctcagtctcatattaagccaaattctccttttgccttttgtctcagtttgcggctggatatggctgccgtgaaaacacaagggctctctaatagaaaacaaaacaaaacaaaacaaaaaactgaaaggagcattgctaagttgactctgacttgtttccagggaagacagcttactacaagtgggatagatttttcttcagtgctagtggtttcaggctgtataggcataatgtttaatggcatatttccaggttactgaccaaggagctagttagactaaaacagcattgttgcagagtggattctccaggaaacagacactgagatggaaataagattgtagaatgtttattagaaactgtgtagagatcaacaccttttaaaaaggggtgtggggaagcagcatcaggcagagagagaagtggaactgtgatgtggcatcaacaccttaagctgttgatcaacagcttaagctgacccagaggaagttctggagttgatagggtctggctgcggtgttccccattaggccaaatgtgagagagccattgtacccctccctggatcagacatcagatgagggccacccctgaagagtgagcctttggtcaatggaaggcaatcagaaaaggctgtttgataaagaaaggtagcttgttgcagcactaaaagctgctgaggcccgctcttccttaaaggggacctaagcagtttaataataagcttaagatatcagaagaacttgacaaagatgcagcaaatacaagaaaataaaagaaaggctataaaatatgtgatagtggactaggagtaggtggaggctcagggcaaactgctagaaaggaaatatgatcatgtggctttacctagtcacaataatataaatatcatgtattgcttttgccatttatattcaacctgttgaaatttggaagatttgtgactacaaggctataaatgaatgcatatgatccccatattaatcaaaatttaaaattatagataaccgatattttgaagttgaagatgaaaaggagtgaaaaagagtaggattactaatatcattaaaagataaagttagaaatcagtaaatactgtctatatgaataggacaagaaatagaggtttaagtatattattctgatttacaatgattaccaatagggagagaataatagaataacactttgaagaatagtagaagtatctattccacgaatatttggtaggtggttacatttgaagtgatataggcatggcactttacaattttctcaatttattctactacagttggcctgtttggatataataaccctattgaagaaaagatatttgttctaaattttcaaatttatgtacataaagttgagaattgagagttatttgaattttctcaataatgatatatctcatttatattacttttttatttctctttttgtgtcctaattagtttattaagtagtttatgttatcagttctttcacataaccatatgcttgaattgtattagctttactctatttgtaccttctaaatgttgttaatttctgctttaatcttggttaacttttccccctctgtctcattagaggtatttattttgctttttaaatttaataattcatttaatttatattttcctatttcagtgtgtagcatttaagacaataaactttcttacagtgaatcatttcatagagtttatattttatttccatatttcatagattgtggtttttcatgttttttaactattatatttagatattcttcaattttttttgcttttccccagttttaaggttttcaacttaaagataccttttgaggaggattctatttttaaaatttaacttccactttgatattgttatcaaaaagcaagttatatattatgtgtaaatgtagaattcactgaagttatattgagactattgagacttcatatagaacaaattttgaatatattcccaagagaatttgaaaagaaagtttggattctattttcaggatgtagaatttagtatcttaatatacatataaaatgtcttacattattatttttatttgtttattttatttatttatttattttttgagacagagtcttcctctgtcacccaggttgaagtgcagtagtgcaatctcggctcactgcaagctctgcctcccgggttcacgccattctcctgcctcagtctcccgactagctgggactacaggcgccccccaccatgcccggctaattttttgtatttttagtagagacggggtttcaccgtgttagccaggatggtctcgatctcctgacctcatgatcctcccacctcggcctcccaaagtgctgggattacagacaagagccaccgtgcccagcccacattattattaatatatagagggaccataaattattattatttttgccctgtgatataccatagaatacagtaagatatatgagtcaaagtcacccactcctctgataaatcaatttcattctgctatttcattctcttccaattttgctgtataaattttcaataacaaatctttattgttgattatacagtatgtatactactatcttaatgactaggctttcaaatcaaatgtgctttttattattgtaacaatatctccattctttttgattgaatttaatcaatgtttactttctagattctctgaattattttgatataggcatggctttaatttatggcaatagttttttgacatagtttttttttttcgtgctacattttattttatttattttatttattttttttattatactttaagttttagggtacatgtgcacattgtgcaggttagttacatgtgtatacatgtgccatgctggtgcgctgcacctactaactcgtcatctagcagttttctttcattacatatattttttgataaggaagctccacctaagtgtatggttatttatttcttcttcttgcctcttttcttcccagataaagtggcctggcagtgtagaaggaattatgcaaaaccccttttcacatttctttgagctggagccagctctgcttagtcatagtcacatttttgttactgtttttttttttttccttgtggtcccatacttcttatagttgtccagatttaaggtagcttttctcataatctttaaagacctccaaatttagttctcacagaaaaataaagtcaatacataaaaaagtttgaaagctattcaacgtgtgacctcttttctagctcccttaatattcattcaatttctttgcctcttaaatatgctcatgtctcaatctttaaagtatttcagtggactcttacggctctcaggataatgctgaaactctttcacctggcttatcatgggcttcatggaaggaatgtgctttcatttcctaccttgcttctgaaaacttcccttcttgcactctaccacacattcacactaatatatgctttaggtccttgatcagtttatagatcttatttggatctgtatttgaacaacatataaagaaaaatattttgagaataatcaaggtaatttaataatgattttatgaaattaagacatcattttaatgtttttagatgtgatataatattttgattttgtttaaacaaagaaatcttattctttacatacacatgatgagaggcttatgataatgtctgagatttggttcaaaataatccgaggttggaaagtaggtgaaacaaggctgtctgagcttataattgtttaaactggatgttgaacacgtggtaatcattataccaatctcttgacttttgtatatatttgaaacttttcaaaattaaaaaataacctttttggatcaaattatggaaatgtattttaatatagttttagatcatatataggcatccacaattaatctattactacatatttatataaaatagtataaaaatgcatatataatttttatttatttactttttggattttgaacttttaagttcagggatacatgtgcaggatatgcaggtttgttacatagttaaacgtgtgccatggtgattagctgcacagatcatcccatcacctacagattaagcacagcatccactagctattcttattaatgctctccctcctcccacccctcaacaggctcaagtgtgggttactctcctccctgagtccatgtgttttcattgtacagctcccactaataagtgagaatatgtggtgtttggttttctgttcctgtgttagtttgccaaggataatggattccagctccatccatgtccctgcaaaggacatgagcttgttcttttttatggctgcatactattccatggtatatatgtactatattttctttatccagtctataatcggtgggcattttggttgattccatgactttactattgtgaaaagtgctgcagtgaacatacgtgtgcatgtatctttataatagaatgatgtatattcctttatgtatatacccagtaatgagattgctggagggaatgctgcctctaggtctttgaggaattgccacactgtcttccacaatggttgaactaatttacactcccaccaacaaaagtgttcctttttctccacaacctcaccagcatctgttgctttttggctttttaataatagccattctgactggtgtgtgatggtatttcactgtggctttatttgcatttctgtaatcatcagtgacattgagctttttttcatgtttgttggctgcatgcatgtcttcttttgagaagtgtctgttcatgtcctttgcccactttttaatggggttgtttttttaattgtaaaattgtttatgttccttgtagacactggatattagacctttgtctgatgggtagattgcaaaaatggtctcccattctctaggctgtccattcactctgatgatagtttcctttgctgtgcagagctctttagtttaattagctcccatttttcaatttttgcttttgttgcaattgcttttggcatcttcatcatgaaatctttgctgtgcctatgtcctgaatgctactgcataggttttcttctggggattttatagtttggggttttacatttaggtctttcatccatcctgaattgattttcgtgtatggtgtaaggaaggggtccagtttcaatcttctgcatatgcctagtcagttatcttagcaccatttattaaatagagaatcctttccccattgcttgttttggtcaggtttgtcaaagatcagatggttgtaggtgtgtggacttatttctgggttctctattatgttccattggtctttgtgtctttgtaccagcaccatgctgctttggttactctagccccatagcatagtttgaagtcaggtagcgtgagtgtgatgcctctagattttttttttttttttttttttttcgctttggattgccttgactattcaggttcttttttggttccgtatgaattttaaaataggttttttctagttctgtgaagaatatcagtggtagtttagtgagaatagcattgaatttataaattcccttggacagtatgactattttcatgatattgattcttcctatccatgagcatggaatgtgtttccatttgtttgtgtgatctctgatgtcttttaggtttgtggttctccttgtagagatatttcacttccctgcttagctgtattcctaggtattttattatttttgtggcaattgtgaatgtgagtttattcctgattaggctcttggcttgacagttgttggtgtatctggatgctagtgatttttgaatattgattttgtatatgagactttgctgaagttgcttatcagcttaagaagcttttagggtgagatgatggggttttctagatataggatcgtgtcatctacaaacagggatggtttgacttcctctctttctacttgaatgcctttatttctttctctcgcctgattcccctggccagaacttccaatactatgttgaataaaagtggtgaaagaagacatccttgtcttttgccagttttcaaggggaatgcttccagcttttgcctgttgagcatgatattggttgtgggtttgtcatatatgactcttattattttgaggtatgttccttcaatacctagtttactaagagtttttaacatgaagggatgttgaattttattgaaggctttttctgcatctattgagataatcatgttgtttttgtctttagtcctgtttatgtgatgagtcacttttatttatttgtgtatgttgaaccaaccttgcatgaagtctctttgattgcggtggttaagctttttgatgtgtggctggatttggtttgccagtattttgttgaggatttttgcattgatcttcatcaacaatattggcctgaagttttctttttttgttgtatctctaccaggctttttttaatcaggatgattctggcctcatagaatgagttagggaagagtccctccttttcaattttttggaataatttcagtaggaattgtaccagctcttctttgtaactctagtagtatttgtctggtcctgtgctgtttttttatttatagctgcttattactgcacaatttcagaactcattattggtctagtcagggattcaatttcttcctgcttcagtcttgggagggtgtatgtgtccaggaatttatccatttcttctagattttctagtttatgtgcatagaggtgtttatagtattctctaatggttgtttgtatttctgtggcattagtcgtgatatccccttatcatttctgattgtgtttatttgaatcttctcttttttcttctttattagctagctagaagtctattttattaatttttttcaaaatccaactcctggagaaatacggaacacttcacaaatttgcatgtaatccttgtgcaggggccatgctactcttctctgtatcacttcagttttagtatatgtgctgctaaagcaagcacaaacacaagtcttgactaagccatctaaactatttttcatctctcttatatcataatataaaagatcatagtaaaaaaaatctgtcaacaaagaataaaagacaatactagaccacgtgtttattttatcttgtattttctggatatagattggtcttatcacatagagaactaacagttcccctaatggttcgggtattgatatgcttttagatctgtatatgttttgtcagtaaaacaaagataacagctctttgattctgccaaccaaggttggctctattcttgcatgaagagtcagctttaagtatatttctaaccaccataacatatttttcattgctctgaaatactagcctattttgctcgttattggcttcatgacctgagtcttttacttctgagaccatagtgaagatgctctattgaaaaagggccttcatatttattcatgtgaacaaaatatacatacgaaaatgagtacgcatgtgcacacacatgtatacaggcacacacacaaagataaatatttaacagtgaaccaggctctgcactagaatctgcaggtataacaaagaactctgtacttatgggaggttaaagtttgagagacatgtggaatggaaaggcattgaaaatgatacagagcaatttatcctggccccgcatttgtgccaactgaggagttacaaaaaatactgtttctgggttccactcaaaatcaaataaatcaaaatgtctggttatgggaccaaccgtatgtattttaaaaattttcccaggaggcactaatgtgtaacaaatactgaaaatactcataaagagcacctttatctgagatcaaatgaaatcgtttctgtgccacctttcttccactgcagtcctcttgcttcatactcccagatttagcaagaagaaaatgaattataacattgggataaagggccagttgatggtgcttggagtttattcatgtatttattctgcaaacattcagtgagcacctattatgagctgtgtgctgggcactctggtggtagttgctaatacaaaattaacaagacattgtttctgctatatcaattaggaaagacaagtaagtaatctgtgattacattcctgaatgagaagtgcaacattgtgagggtaaatttaagttaagtaaaagtgtgaaacctggacatgggtttttaaaacaaaaggaagaagttcctttttctcttttctgttttgccatttaattcatttgcagaagaaaacaggtaatttgaccatggattttttgcttattttgaccttctgtttatttttactttttttttctccttgcctcttgtatttcctgtaaactgttagctaaatctagagacttgttcatattcaggttcgagtatgggctggaatacttcatcagtaatgttgagtacttccatcaagagacccatgctacctgttttaagtgtctttttggattttatggaccattattttcattccctaaatccagtattttgtcaagaactttaagtggttattttcttttactccttcttagtatatttgccataattttctatgaagagaaactttctctgattgactagttatgctgcagtacagtgggtataggaaaatcaagataaaggcttgcttctttatcagttttcaaaatgatgagttggtacttgaatatcagttaaagtagactgctgaaggatttttcctgttatcattatgaactaatgtttttaaaaattaatctcctcagtccattacattttttttccctgaataatcccaactttggtcaatgacagccacttcagattggctccagagaactttagacttgaccccggtcatcattgataacttccttgtttctggtatgataaaatgtaaccaacatatcttataccattcctgatctacactgagaaccagtcagcccaacaagtaacttagtgggtgttggtgtttagggactcaatctgaaaacttacctggagttatataacctagggaggatggcagtgcttttctgagaatgagcaagaaaatgggcattccacataggctgaggagtgcatggtggtgtgcaggaaaatcatgccatagagacaacagccttttaaaattctttttccttactatttttaatcctctaaggcatatgtttgcaggctctttctccatggcttacctcctttgatgatgaaaaggtgtgtgataatagcaggcaatcgttttataaattaccacttcatttcatggggttctgtgtctgtcaaggtatatgacaatcaggaaatgcttactgaatagtcactatgctagctttaagggattcaaacaggattaaaaccttatttcacgttgtccttcaggttatttcaatagagtgatgaatgctattgttggagcccagaacaagaaagtaataaattctgcctgagtgaaaaagagaagcagtcatgcagtgagttttcataaaggtcttaaaggaataaaactttggtgtgtgtgtacgtatgtaacaggggatagggagttggggcattatttaaaacagaacagctgtaataaagacaaagacacagtgatttaaaagtggaaaggtagtagatccaggtggttagagtatagagtgcctgggtggaagttccaacattatgctgagaagacactttcagtcagtttgttggtgtagcaaggtcacttataaagttattatctaaacttgaataatcacagttggcattaaatagagaggcatatattatgagacactgtacaaatagaacagtcattctggtgagtggatgtgaggaaagatttaaatatgacaacataattttgttatgatgactgttattagagcttggatgataatggagtgagaccaaagtagggtagttagagctcagaaatagccagacaagacagagaaggatattaaaggatttttttaaaaatcacaaaacataaagaaatcaaaaagtagacaatcaagtatccaagaaatttactggtaaatgtcagataattggcaggaaagctattgaggttaaatgttcaacaacacatccatccatccatccatccatccatccatccatccatccatccatttattcattcattcgtaatcatttactcaatgattatcaaggcctattatgttcatgtgtcttgcaagaaacacatagaaaaataaaacttggtcccaccctttgaaatggtgtaatacagtaatagataactgagattcacagccacaactttcagtctagtgttggttttgtcagatcacccctggacagtccatctcactgggtacactttgactctgtatgttaaaccaaagtaattcggcagtcatcccttttcactaaatgttgacactaggtgatcatgaatagtctctgggcttgggcagggccatttgggaattaccattttggaacacccatgtgcttctgagcatttttttttaatttcaacttttattttagatagagggggtacccgtgcaggtttgttacatgggtatattgcatccaggtagtgagcatagtccccagtagttagttattcagcccacatcttctccctcccccctccccccccccccactctattagttcacagtgtctgttgttcccatctttatgtccatgtgtgctcagtgtttaattcccacttataagtgagagcatgtgatatttggtattctgttcctgcattaatttgcttaagattctggagctgagcatgctgttgatcaagtctgtccacatcaaatgtcaaggattcaaaacaccctatcatataagatggccattcactttttacagtccagacctcaagtcagtggtgtacttccattactaatggagaaggtgtgtcccaactcctgccctagattcataccatagctaagtaaatgaaaaattctcaaaaaattatctacttattaaaataagcataacttattttctgtcaaacaccaagtattttgcatctgtttgtaaatagagcagtttgcaaactacaagtgcgcatttcaaccgattcctagtcttttcactctctctttatgttcatctttcttaatatagtctcaaaacacccccaaggggattggtgctgattcttgcttattttatatcaaaattcttgagagcttgttcctctgaaacagggctctttttttccttcattttaaggcatcttctctgactatttcctgctgaaaaaaaaaaactaataataacctcccacctcttgcactaatttcccactgataatgggatcctggtcatggactttctgcctaagatcacttttaatattttttccctaaaaatacagatgaaggacttcaaagctcttttgttgttttttatacttttcccacttgaggagttacacaactcttgctgctggacattcaactcatattgaacacaatacttgtacacaaattagcaatttctgttgactatcccttgagaaagagaaatgtcagacatctgatctcccccaaacaaagtgatgattataaaaattatgtaaaaaatttcacaatgccttacaccaatgtattatgtacttcttcacatggctatgaagaaatacccaaggctgtgtaatttataaagaaaaagaggtttaatggactcatatttccacatagctgggaaggcctcacaatcatggtggaaggtgaaggaggagcaaagctatgttttacatggcagcaggcaagagtgtgtgtgcaggggaactgccctttataaaaccaccagatcttgtgagcgttaatcactatcatgagaacagcatgggaaagcccacccccatgattcaattgcctcccaccaggtccttctgaagacacattagggattatgggagctataattcaagatgagatttgggtgaggacagagccaaatcatatcattctgcctctggcccctatcaaatgtcatatcctcacatttcaaaacgaatcatgccttcccaacagtcacccgaagtcttaactcatttcatcattaactcaaagtcccacagttcaaagtctcatctgagacaaggccagtcccttctgtttagagcctgtaaaatcaaaagcaagttagttacttcctatatacaatgggggtacaggcattgggtaaatacacctgttccaaatgggagaaactggccaaaacgaagggtctataggccctatgcaagtccaaaatccagcagggcagtcaaatcttaaagctccaaaatgatatcctttgacaccatgtctcacatccaggtcatgctgatgcaagaggtgggctcccacagtcttggccagctctgtctctgtggctttgcgggatacagccctccctgctggctgctgtaataggctggcattgagtgtctgtgtcttttccaggtacacagtgtaaactgttggtggatctaccattctggggtctggaggatgggggccctcttcttgcagctccactaggcagtgccccagtggggactgtgggcgtagggagctctaaccccacatttgccttccacactgccctgtcagaggttctcaatgagggccccatccctgcagcaaacttctgcctgaacatccacgtgtttccatacatcctctgaaatctaggcagaggctcccaaacttcaattcctgacttctgtgcactcacagactcaacaccacatggaagctgccacagcttggggcttccaccctctgaagccctgacctgagctgtaccttggcacagtttagtcaaggctggagcagctgggacacagggcaccaagtaccaaggctacacacagcagtgggggcctgggcccagcccacgaaaccattttttccttctaggcctctgggcctgtgatgggaggggctgctggaaggtctttgacatgccctggaaacattttccccattgtcttggcagttaacatttactcctcattactatgcaaatttatgcagccagcttgattttctcctcagaaaatcagaagatgggtttttcttttctattgcattgtcaggctgcaaattttccaaactgttatgctctgcttcccttttaaacattccaaacattttaaatgttccaaaccatatctttgtgaatgaataaaactaaatgctttaaagagcacccaagtcacatctctaatacttttctgcgtagaaatttcttccaccaaataccctaaatcatctctctcaagttcaaagtttcacagatctctagggcagggtcaaatgctgccagtctcattgctaaagcataacaggagtcacttttactccatttcccaacaagttcctcatctccatcagagaccacctcagcctggactttattgtccatatcattatcagcattttggtcaaagccattcaacaattctctaggaagttccaaactttcccacatcttgtcttatgagccttccaagtttttaggaagttccaaactttcccacattttcctgtcttcttctgagtcctccaactgttccaacctctgcctgttacccagttccaaagtaacttcaacatttttgggtatctttacagcagcaccccattacttcgtactaatttactgtattagtccattttcatattgctatgaagaactacccaagactgggtaatttataaagaaaaagagatttaatggactcacagttccacatgactggggaggtcttataatcatggcagaaggcaaaggaggagcaagggcacatcttacatggtggcaggcaagagaacatgtacaggggaagtgccctttataaaaccttcagatctcatgagacttattcactatcatgagaacagcacaggaaaacctgcccccatgatgcagttacctcccaccaggtccctcccatgacatgtggggattgtgggagctacagttcaagaggagatttgggtgagggcacaaccaaaccatatcaaccaaaaagctccagtttctgtaaatgtgttcatgttattgcactagtcaaatctgcagagaatctacactgtcttccacaaaggctgaactaatttaccctcttaccaacagtgtataagtgttcctttttctccacaaccttgccagcatttgttattttttgactttttaatagtagttattctgactggtgttagatggtatctcattgtgattttgatttgcatttaatgatcagtgatgttaagctttttttcatatgcttggtggccacatgtatgtcttcttttgaaaaatgtctgttcatgttatttgcctactttttaatggggttgtttgttttattgtaaatgtgtttaagttacttgtagatgctgaatattagacctttgtcagatgggtaaactgcaaaaattttctcccattctttaggttgtctgtttactctgttggtagtttcttttgctgtgctgaagctcttcagtttaattaaatctcattttttcaatttttgcttttgttgcaattgctttgggtgtctttgtcatgcaatttttgctcgtacctatatcttgaatgctattgcctaggttgtcttccaggatttttataggtttgggttttacatttacattttacatttaaaatccatcttgagttgatttttgtatatgatgtaaggaaggggtccagttttaatcttctgcatatggctagcctgttatcccagaacaatttattgaatagggaatcctctccccattgctggcttttgtcaggtttgtcaaagatcagataattgtaggtgcacagtcttatttctgggttctctattctgttccattggccctctatgtgtctgttcttccagtaccatgctgctttggttagtctagccctgtagtatactttgaagttgggtagtgcaacgcctccagttttgtttcttttgtttaggattgacttgacaatttaggttcccttttagtttcatatggattttaaaatagttttttctaattctgtgaagaatggcaatggtagtttaatgtgaacagcattgaatctacaaattgctttgggcagtatggctattttcatgatattgatacttcctgtccatgaatatgggattttttttaatttgtgtgatctctgatttctttgagcagtggtttgtagttcactttgtagagatctttcactttcctaattagctgtattcctaagtattttatcctttttgtgacaattgtgaatgggagttcattccttatttggctcttggcttgactgttgttggtgtataagaatgctagtaattttttcacattgattttgtatcctgagactttgctgaagttgcttattagcttaagaagcttttgagctgagatggtggggttttctagatataggaccatgtcttctgcaaacagggatagtttaacttcctctctttgtatttgaatgcctttatttctttctcttgcctgattgccctggccagaacttccaatattatattgaatagaaatggtgagagagggcatccttgtctggtgctagttttcaaggggaatgcttccagcttttgcccatttagtatgatattggctgtgactgccctatctttcaacattactctaaacacagcattcttttgtagttatctctggctcttcctactccttccaaaggccaagatgtacactctggatgattacacagtactttaaaagtacttcaaaggtaattctttttatcattatctcatcaaggctgtataatccaggtggacaggaccatttgtcttttattcttagcatatttttagcatatggagaatactcaataaaatttgataaaatttcctttttagctcttagtgcagtcattacttgcttactaggttattacgcatgaaatccaagattacagaacacttagaagaaggtacatttcttatatttttgaaaccaaattgtatacaaagtaagcacagtttgagttaaagttgtttcttggatttattcttacttatgtttatttaaaatttgattataagaagatatatgccaatagtgcagatgtaaaaaaaaaaaaggaagacttaaaatttactgctatctactgttaagtagctctgagttcttaaaaatgtaattatgtttgtaacttgttaaattgaaggtttttaaaccataaaacccataacaaataagatttatcgtatttccaattccatgctgtttgagaaatacatttttttctgaaggcttagcaaataaatatttaagttgaatataaacttgaatttttcactaaacttttaaaatatgcttattaaatgttcttattccttaaattacaatgtaactttggatgacttgggtggttttgagattatttgaagaatctcttttttcaaaagtatgtattaaggtataaccagtccaccaattctgttacttttctactgatgtttttaagaaatttgacttaatagaggcttacaaatggctccttaaataggagataggcgaactgaatggaatagacctaattccccaaatattagtttaaaatttacttcaaaaagataaaaattagtttatacttgaggaatattttcaaaactgaattataaaatgaaattttaggagttgatttttgacttaggtaaccagtatttgatgattttcatgctcatacaaatattatcaaattgaaacatctctttttctctgaaaggccaactttgtttctctgtggaattcctcactgttttatgtgtttggtcacatccaaaaagtttgtctttttgagttcccccttttctgtagatattctccttggcgtttcaccatagtccatagacgttagatcgtcttctccaccatgtatattattcaggtgatgggtgctctaaaagccctgactttacccctatacaatatatgcatgtaacaaaattgcacgtgtactgcgtagatttgtacaaataaaaagggggaaatatattattggtcaccaacaaaaagagcacatgaattggtgaatcttaactaaaaagagaactgcaaggcaattgatgtgttaattagtgtaatgtggcaatcatttcacaattcatgtgtatgtcaaatcattacactgtatatctcgaatatatccaactgttatttgtcaagtatacctcaacaaggctggaaaaaatgggaaaataaataaataaatgaaatgatgagcaataatattttataaatgtccttacatgaaagaatattttctctttggattttttctgatccaagtaattgcaattgcaaaaaccaggaatcactaatgtagagatatggatggccaatttgggttgcttatactatgactatatcagaaatgcagcttattcctttctccaaatagtccctgagattttgcagatgtccatacagcagaaataggtcttagtttgtggcttgcatgcaaatatacaaagcttgattgtaggcataaccccttttttcctatagatagtttatgagaatgttgcaatcaaaaccatgtcctaacattcccagtgtgctcccaaatcccttgtcccagttagcatttagttatgtgagcaaactgatttcacaatgagtccatgagataactgaatctgtctccagaattttagtgtgatcgtgcttaatagcaaatgaccatttaaggtccccacccaatcctaaaacagccttctggatttcaagaagctatataatagctggttatgccatcattaagcctcaattaaatgattattaaggcctttctgtgcttggagttatggggaaacatagaaatgaatgcaaaagttataatcctttcaaaatattttttattgcttgcgcttgattacatattaaaagattttttttttctttttttgagacagagtctcgctttgtcacccaggctggaatgcagtggcctgatctcagctcactgcaacctctgcctcccgggttcaagcaattcttctgctcagcctcccaagtagctaggactacaggcacatgccaccacacctggctaatttttgtatttttagtatggacggggtttcaccatattggccaggctggtctcgaactcccaacctcatgatccactctcttgggcctcccaaagtgctgggattacaggcatgagccaccctgcccgtaatgcactcttgtactttaaaggaagaaatgaagaattaaaggaatgaagaagccaaaagattttatcaaggcagagctatatctattaagccttcaaagctaaacttgtttttcccgagttgtcaatgtcccagataaaataaaatttgatcttgattagccttttattaaatagaccaataaaaagttaaaattattatgtttgtaaaatgtattttgaataacatggttcagatattttcatatagcagtaagtatagattggaaataatataaacagttaaacctggtcattgtactacttataaccttaaaaggaaataaaagtataaatgggaataggaatagattacctactaagaaatgatatgttataatagcaagaataaataatttgcctatttcttaatgatctgaacaaaatgtgtttttcagagattttttgaatcagaaaagtgtacctataacatattctatctaagaatttaaactggtgataaaactggaaatagaaaagaataaagattgcttctaaatagaaaatgcttaaaaccagcagtatttattgatattttgtgcaataaaagaaaatgaaagatgcagttatttcagctgctttctcaggtaaagctgtttttaaagaaaacttcttaaagctatggctaacccagctcccacgtgaaatgactttttttatgacattttcaatgtaccttcaatgcatgtacttctagtctaaattattagcctaggctactttccctttactcacctcagatagcatttttcaagaaataaacttatgtacatcacaagtggaaaataaaaccacgttctatttcttcatttataggaggttgaacttctctggagtgctagagctatagatttttctggatgtgtgcttcagagtgaagtcaagtgatattacttttctcttaaattaccaaccaattgaaaaaaaatccttagttctaaatttcaaattccaccgatatcataagtcatacaaaagcactttgcttttcaccctttattttttaacattgtctatatgggaatggacaactcttgattactacagctaaattgtcagttttatgaattacttcctataaaaatgacctcctttgccctgcaagtatagtttttttgttgtttttttgtttttgtttttgtttttgagatggagtctcactttgtcacccaagctggagtgcagtggcgatatctcagctcactgcaacctccacaccccaggttcaagcgattctcctgcctcagcctcccaggtagctgagattttaggtatgcaccaccacacccggataatttttttcacatttttagtagacacagggtttcaccatgttggccaggctggtttcaaactcctgatctaaaatgatccacccacctcggcctcccaaagtgctaggattacaggcgtgagccactgtgcccagccaagtgtagcgttttttaatgcaaacaagcatatgataaggaatttaaaaggaggctgcaaaaggtcagaaaaattgtacaaacctatttcaacatggagttctttcttgagtctctttattactttcacatttcctgcagaaagctaaaagttcactagcaacagtgcataaaagaaataatagtaaggcggtgtaatcactaaggagctgaagcactggcatctcttaaaatgctggattacctcagtgctgatcagtggaaaatcaaaaaggatgagaaggatgacaaacacttttgagctctgaatgaagaggatactgccttgctgaaaaatcgtggtcagagcacttattctaggcagattaagcaggttgagaatgacattcaacaacttcttaagaaaattaattatctcagtagtgttaaagagtctgacactagcctggccaccaccagcactctgggatttggctgcaaataagcaaatgctccagggtgaacaatgtttacaggttgcaaggtgtagaaagatagtaaatgctgattctgagaactcaaaatacattgtcaatgtggagcagattgctaagtttatggcagacctcagtgatctactgacattgaggcagggatgaaatttgatgtggaagaatgtaagtattaaattcatattcccatactttctaagattgatccaacaattaccatgatgccagtggagtaaaaacctgatgtcatatacagtgatgttgttggctgtagggaacagattgagacattgtaagtagttgaaaccccactacttcatccagagagatttgttaaccttggcatggagcctcccaagagtgtgctctttggtccactaggtgcaagacactctgtgcttaggtggttgctaaataggactgatgcttgcttcattgagttattggatattaacttttacagaaatatatctgcaaaggggctggaatgattcatgagctcttcccaatggccagaacaagaaacgcctgccttatcttctttgatgaaactgatgctattggaagagctcagtttgatgatggtgctggaggtgacaatgaagtacagagaaaaatgtgagaactaattcatcagttggatggctttgaccctcaaggcaatattaagtgctgatggccactaacagacctgatactttggattcagcactgatgaagccagggaaattggatagaaagattgaatttagtttacctgatctagagggtcagactcacatctttattttttttcttttttttaaaattatactttaagttttagggtacatgtgcacaacgtgcaggtttgttacatgtatatacatgtgccatgttggtgtgctgcacccattaactcgtcatttaatattaggtatatctcctaatgctatccctccccactccccccaccccacgacaggccccggtgtgtgatgttcccttcctgtgtccatgtgttctcattgttcaattcccacctatgagtgagaacatgcggtgtttggttttttgtccttgcgatagtttgctgagaatgatggttttcagcttcatccatgtccctacaaaggtcatgaactcatcttttttatggctgcatagtattccatggtatatatgtgccacattttcttaacccagtctatcattgttggacatttggcttggttccaagtctttgctattgtgaatagtgccccaataaacatacgtgtgcatgtgtctttatagcagcatgatttataatcctttgggtatatacccagtaatgggatggctgggtcaaatggtatttctagtactagatccctgaggaatcgccacactgacttccacaatgattgaactagtttacagtcccacaacagtttaaaagtgttcctatttctccacatcctctccagcacctgttgtttcctgactttttaatgactgccattctaactggtgtgagatggtatctcattgtggttttgatttgcatttctctgatggccagtgatgatgggcattttttcatgtgtcttttggctgcataaatgtcttcttttgagaagtgtctgttcatatccttcgcccacttgttgatggggttgtttgttttttttcttgtaaatttgttggagttcattgtagattctggatattagcccttcgtcagatgagtaggttgcaaaaattttctcccattctgtaggttgcttgttcactctgttggtagtttcttttgctgtgcagaagctctttagtttcattagatcccatttgtcaattttggcttttgttgccattgcttttggtgttttagacatgaagtccttgcccattcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccaggaccatttattaaatagggaatcctttccccatttcttgattttgtcaggtttgtcaaagatcagatagttgtagatatgtggcattatttctatgggctctgttctgttccattggtctatatctctgttttggtaccagtaccatggtgttttggttcccgtagccttgtagtatagtttgaagtcaggtagcatgatgtctccagctttgctctttttgcttaggattatcttggcaatgtgggctcattttgcttccatatgaacattaaagtagttttttccaattctgtgaagaaagttattggtagcttgatggggatggcattgaatctataaattaccttgggcagtacagccattttcactgtattcctatccatgagcatggaatgcccttccatttgcttgtgtcctcttttattttgttgagcagtggtttgtagttctcctcgaagaggtccttcacatcccttgtaaattggattcctaggtattttattctctttgaagcaattgtgaatgggagttcactcatgatttgactctctgtctgttattggtgtataggaatgcttgtgatttttgcacattgattttgtatcctaactgtttgccgcagttgcttatcagcttaaggagagtttgggctgagacaatggggttttctaaatgtacaatcatgtcatctgcaaacagggacaatttgacttcctcttttcctaattgaataccctttatttcctttttccgcctgattgccctggccagaacttccaacactatgttgaatcggagtggtgagagagggcatccctgtcttgtgccagttttcaaagggaatgcttacagtttttgcccattcagtatgatattggctgtgggtttgtcatagatagctcttatcattttgagatacgtcccatcaatacctaatttattgagagtttttagcatgaagggctgttggattttgtcaaaggccttttctgcatctattgagatgatcatgtggcttttgtctttggttctgtttatatgctggattacgtttattgatttgtgtgtgttgaaccagccttgcatcccagggatgaagcccacttgatcatggtggataagctttttgatgtgctgctggatttggtttgccattattgtattgaggatttttgcatcaatgttcatcagggttattggtctaaaattctctttttttgttgtgtctctgccaggctttggtatcaggatgatgctggcctcataaaatgagttagggaggattccttctttttctattgattggaatagtttcagaaggaatggtactagcttttccttttacctctggtagaattcggctgcgaatccatctggtcctggacgttttttggttggtaggctattaattattgcctcaatttcagagcctgttattggtctattcagagattcaacttcttcctggtttagtgttgggagagtgtatgtgtcgaggaatttatccatttcttctagattttctagtctatttgtgtagaggtgtttatagtattctctgatggtattttgtatttctgtgggatcagtggtgatatcccctttatcagtttttattgcgtctttttgattcgtctctcttttcttctttattagtcttgctagcggtctatcaattttgttgatcttttcaaaaaaccagctcctggattcattgattttttgatgggtttttttttgtctctatttccttcagttctgctctgaccttagttatttcttgccttctgctagcttttgaatgtgtttgctcttgcttctctagttcttttaattgtgatgttagggtgtcaattttagatctttcctgctttctcctgtgggcatttagtgctataaatttccctctacacactgctttgaatgttttccagagattctggtatgttgtgtctctgttctcattgatttcaaacaccatctttatctctgccttcattttgttatgtacccagtagtcattcaggagcaggtttttcagtttccatgtagttgagtggttttgagtgagtttcttaatcctgagttctagtttgattgcactgtggtctgagagacagtttcttataatttctgttcttttgcatttgctgaggagagctttacttccaagtatgtggtcaattttggaataggtgtggtgtggtgctgaaaagaatgtatattctgttgatttggggtggagagttctgtagatgtctattaggtctgcttggtgcagagctgagttcaattcctggataaccttgttaactttctgtctcgttgatctttctaatgttgacagtggggtgttaaagtctcccattattatagtgtagcagtctaagtctatttgtaggtctctaaggatttgctttatgaatctgggtgctcctgtattgggtgcatataagattcatacttgttcaatggatgttgaaagataccagatttgcatggttagcacaactacatctatacagcactggggctgagattagacgcttttgtgtagaagctaggtttttttgttttgttgttttgtttttggttttggttttggttttggttttgaaactgagtctcacactgtcacccaggctggagtgcagtggcacaatcccggttcactgcaacctccgcctcctgatttcaagcgattctcctgccacatcctcctgagttgctgggattataggcatgtgccaccatgcccagcttattctgtatattaagtagagaccaagtttcactatattagccagactgatctcgaactcccgatcaggaactctcgatccctcaggtgatccacccacctcagcctcccaaagtggtgggattacaggcgttgagccatgcctggctgtagctggtatgtttttgatcagagcatggtaaaaaaatgctactgaggattgcttggaagacgtaaataagatcattaactattatgccaaattcagcactactcactgctaacatgacatgactgagccctgaaggctttcaaatgaaaacacatcttttcattggaatcctaactttgtatggagttgttaataaccacttcacaaaaaagacttcaacattataaaataataatagtaattgtcatttactgaatacgtgatacttgtgccaagttactgtgctgaccatttatgtttatttgataaatatttattgagtacccactatgaattaggatgaggaagatgatcactgccttcaaggagcatataatcaaatataaacagatatgcccaaggcaatgataaggagactcagtgggaattatgaaagcaccgactagcctgaggtaaagctttctggaaaagtttttgattgagctccatattaaagaaattagaagattgcatttgaagatgaagagaaatgacatcctaagcaatgaatttgtgtggacaaaagcattgatgagaaaacactatctgtgttcaaagaactacaaagaagttagtatttgaaaggtcagaactgagaagacctgaggctggaaaggtatgcagaattaaaatcgtgtaagaattggcatgacattttaagatacccaaacttttttctgtaggtgagagaaatcaatcaagactttgaaaggccatacatggcatatatgcataccttacatacatgtcagggtacagtttgtatttatgaagatgtattagttcaggctgccctgtcaaattgtcatagatagggaagtttaagcaacagcaatttattttttgcacagtttaggaggtagagaaatcaatcatccaggggctggcaaagcaagttttacctgaggcctcctctcagctggtaggcagtcgccattttgctgtgtgctcacgtgacttctttgtgggagcaaagagagagcaagctctctggtgtctttccttatgaaggcactaatcctattatgaggattctaccctcatgacctcgtctaactcattacctcccaaaggccccatttccaaatacaatcacattggaggctggggttttgacatgggaatgtattgagacacaaacattgagtccataacaggggagaaggaaagaaacagaagagcagccgtgaggtgaaatcagtgggtttgaatggtcatttgattgattgattgattgattgtagctcagagagaagatacagtctacttttttctctacccattgtaacccatcaactctatgccaccaggtgaggctactgcactagtcttcatcctagttcccttcctgctctttacccaacccccaccatcgtctccactaccagccctcattccaccaccctcctcagcactattcagctcctttctagtacctgattctctcccaatttaggacatttgcacattctagtggagaaaataggtaagtatacaaataaatgcaactcagtatgctaagtactactgaatcacagaagttactaatggtagtatagtcagttctgttataaatatgacatacatgttcctgaaaaattatcacaccatgtagaattacacaatttaaaaaacacagggctaatgatcaaatgggcttggagttcagcattcaaaaattttgtcactgccatatttttaaaaataagaatctaatgaaaatgacaatgtttgtgtgtgtgtgaatagttaagaaacacatacatgatacaataatgtgggtatttttaccataaaatctggtttgcttttggaagtgagtattaaaagggttgcagcttgtgaattattaggaagtaggaggacagtgagctgaaatcagaggaaaggttgtattaggtgcagataggtgtggcttataaaacacccagtgaatggagagagctggtgcatgtttgtggtatgtgtggattagggtacattttgtgtatctccacttagcttggacacagctggtgcagtttttttgcattccccacatgtttctcatggaggaaatcatgcataagtaaccttaatttttttctttttatcaattcctttagaacaaatttactttttcaaaacaggcattatagcaaaactgacaataattgtgccatgaacagttggaaaaattatcacaaaagtggtgaagtaaactgagccttctaacatgaaaagctatatatcagcagaaaagaggaaagggaaccaggccaaggaaacaacatgcatagaggggaccaagtgtgaaagagaacatcatgtttggcaaactgccagcatgttatttagctatattaatacatcatattgtttgtttgtttgtttgtttgttttgagactgggttcagctctgtcgcccaacctggagtgcagtggtgcaatctcagttcactgcaacctccacctcccgggttcaagcaattctcctgcctcagcctcctgagtgtttgggattacaggtgcatgccaccacgcccagctaatttttgtatttttagtagagactgggtttcaccatgttggccaggctggtctcaaactcctgacctcaaatgatcctcccatctcggcctcccaaagtgctgggattttaggcatgaaccaccacacccaaccattacatcataatgtttttaaaagttttatcaaacatattttcatcatcataagtgttgtaattcacttccttttccaacatttgattatttatttcttattccccccaatgacgggaaaaataatttgacttcatttgatgtctaaaaccttcattttatatatgtgcctttctttttgtgtaacccacctaataacatggcaacattgtaaaaatttcaaatactttcactctaactgaattaactttgccttgacattaaatattacaaatagtctttccatgttagaaaatatctttcacatactttgaaataacaaaaatggcaacttcatgaattctaatccaggggtaatcatgttttcattttttgtgttctgatatattacaaacttgatggtttaaattaatgttaattagaatttttaattcagccaaagaaatattgttccttgaggtttaacctattctatttcaaattaacaaaatacaaaatgtattcttatattacatggattcattaaatcaattaatagtcacttattaaatgcctaccatatgcataaaatgatcttagggtctatgagtctatttcatttcatttcatgtcttataatttccaatgttccctcttgttgagtattgtatatctgtactcagaacactcttgatagaagcacatcgaatgggaaaaaatacccgagtgaaaacaacattattatttcactcaactgattaggttaattgatttcctgatagacgtaggccttattccacatggatgatcaaatttattatagtttccgatcctttgagaacactgaaatctaagttttacagtgacttactgctttatatagacaagtatcttgtttagctcagttacttgaaacacaaaaaattgtaataatttaaaaaatgtgttgcataattggcaaaattactgaacctattcaaactacttgtagtacactgaattttttagggttctatgaagtactctacagaagttttctagaaacttcttttattttctgcaaaaattctgtaattttttttgtttggggtattcactctctcactacatcttgaagacagttgtgtcattgaaattgctgagattgttaatgtaatgactgttataatgcaagctctgttaggtaaatcctttgattcttatttttatttctcatgatcccatccacctttttgctcagttcattttttgggcactttacagacagaaataatatgagaaagataatatactcataatcagttaattctactctttttggggataaataaaagaaaaagaatttaaatggacaaatggacactcaaagtatttcatttatttaattcctcccccaattgccattgatgaactaagctacttctcactcctcatagtttttttttttctttagcttaggaacgcatatttgtaatatgaaacaatgctggataagacttgcctttctgtgttaaataatatgtaatattcatcagtatagaatttatttggaagaggccttggaattccataatctagaatgttaggtgacaaaataacaggatacaaataaaggcaaatatgtatccaataagataatttcaaaatatactacaatgttgtagtaatcgaaacagcctgatgctggcataaaaacagatatatagattgaaggaacaaaagagagaacccagaaatacaaccacacatatgtgatcaattaaagtgtcccaagaacacacaatggggaaaggaaaatcacttcgataagtgttgctgggaaaactggacatcttaatgcagcagaagaaaaaaacttgattcttgttttaccctatatacaaaaatcaactcaaaattgattaaagatttaaacataagacctgaaactgtaaaactagtagaaaaaaacatagggaaaaagctttttttacattaatctgggcaatgcttttttactataaccccaaaagcaaaggcaacaagagtaaaagtagaaaaataggattgcatcaaactaagaagctttttcacagcaagggaaacaatcatggagtgaagagtcaacctatgaaatgggagaaaatatttgcaaacaatacatctcaaaatgggttaatatctaaaatacgtaagaaactcaatagcgaacagcaaataatctgattaagaaatggttaaagggatgtcgaaagaatttctcaagagaagacatacaaagggccaacaggtatacgaaaaaaaatttcaacatcgctaactatcaggaaaatgcaaatccaaaccgcaataagatattaactcatacactattagactgactcatacacattggaatgactttttttctttttttttttaaatttattattatactttaagttttagggtacatgtgcacaatgtgcaggttagttacatatgtatacatgtgccatgctggtgcgctgcacccactaactcgtcatctagcattaggtatatctgccaatgctatccctcccccaacccccgaccgcacaacagtccccagagtgtgatgttccccttcctgtgtccatgtgttctcattgttcaattcccacctatgagtaagaatatgcggtgtttggttttttgttcttgcgatagtttactgagaatgatgatttccaatttcatccatgtccctacaaaggtcatgaactcatcatttttatggctgcatagtattccatggggtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctctccagcacctgttgtttcctgactttttaatgtttgccattctaactggtgtgagatgatatctcattatggttttgatttgcatttctctgatggccagtgatggtgaggattttttcatgtgctttttggaatgactattttcaaaaagacaaaagatagcaagtgtcatcaagtgtggaaaaaaaacagttttacagttgatgtgaatataaattggtacagccctgatggaacagtattgaggttcctcaaaaaattaaatctggaacagctacatcatccagtaattacactacttgtatattgaaaggaaatgaaatcagtatgtggaaatatcatcactcctctgttcattgcagcattattcacaacatccaagatatgaaatcaacctaagtttccatcagcgaatgaatggataaagaaaatgtggcacatataaatacagtggaatattattgagccttaaaaaatggaggaaatcttgtcttttataaccacatggatgtatttagaggacatgatgctaaattaaataagcgaggcacagaaagacaaatactacatgatctcatttacatgtggaatctaaaaaaatcaaatccataaaagcagataataggatggtagttggcaggggctgaagaatgggagaaattggaagatattggtcaaagagtataaagttgcagttttgcaggatgaataagtttgggagacctaacctacagaatggtggctatagctagtgctgggagagtagaccttaaatggtctcatcacacaaaaatggtaatggatgtgttaagtggcttcattatggtaatcatttcttaatttgtatgtatatcaaaacatatacaattataaattgtaaatatatacaatttttatctgttaattatacttcaataaagctagaaaatttaaaaacaaaaaaatttaaaaataaatttctaaggtaaaggaactattgtttttaataaaattaactgtttctcacatgcatataacatagaaatccatctttaagtcttatagccaaatattaaatattttaaatcagaaaattaaagagaagaaagtggatgataaattctaaagctggattatgaggacccagattttggagatattggtgatatcatccattaattcacattttaaaataaatttatcagtgaagcaaagttatagaaatgtaactatataggtggaaaatgacataactactttcaaatggtggaattgctaattttttatctttgtaagactgatttttgaggttaaaagaaaaagaaatctagcatctccaagcattttatagtaataacattttccaggcaagtcaaagcactgtttgaagaatttccacatgtctggcatttattaaacctaaaagttaaaattactttctttagttttattagactacaaacattttgtattgtttgtcaggataactttatatgggatctagaaatgataaatgggcttgtgatgaactctcctgaaggaaagccaaagggactttggtttctgtcatatataaaatacggcattctggtttacaaggaggttatctttgtccacagatcactcttgagatagaatctagggcactctggccatctctggctatttgcaagtacagattatatttcagttctctaaatgtttttgctggaagaaaatctgtgcactttaatcatagtttattttcatcattaagtagttgaaatgacagtgaattgagaaagattcaaaaacaaagagtaagacttccaaatcattatctgattatattcctaaggagctaagcacagccccatttaattaaagaaagagcaaatgagcaccttctaaaccaaacatgctgggctttcttcctcccccctcccctcatatcttgtatagaagtggtgaggcctatatcagatggattcctggggtgctaggaaagcaatagaagagagtgagtcccctggaggaaagggaggaaagggatattccaggtagatagaaagcacatgcaaaagaagtgatactaaaataactggagtgagaaaatatagtccaactttctcatgtgcatagatacaaaaatcctaaacaagagcaaaatattagcaaatcaaatgcagtgattcatagaaagtataaaatatcatgatcacattgggtttattctagaaatgcagatatggtaaaacatttaaaaatataccaaaatatttcacaataaatgagaaaaaattatacatcagtagatatatttgaccaaattcaatatccaatcatgatttttaaaaaaaactttggaaaatcaaaatagaagggatgtctttaatgtaacaagtttctgaaaatagaaaaacatgcacatgagtaaaatcatgcttagcaatgaattattgaaactttacgccttgaaatgaagagtgagaaaaagatgcacattctcaccacttatatttagtattacactagatgtcatagccactgaagacagaaataaaaaacatccctatttatagacaacttgattgaacatatagaaaaatcaaaaacaatatggactgctcagttagaattagttaagaagttccagaaggtcaatatacaaagtcatttttcattctatgtaccagcaatagcaatcaaacatagaatatgaaattttaaaggggtatcacttagaatagcttttacaattctaatgtttcagcataaatctaatggaaggtgtgtaagaccactaccctgaaacctgcaaaacctgttcatggatttgaagacctaaatatcatttctcacaaattaatctatagatttagtgaaatatctatttctcacaaattaatctgtagatttagtgaaatatctatttcaactatttctggtattcatccttttgctgcagaaactgaaaagctaaaaatgcaaagtatgtagcattattttgcatgtgtatgttgtaacaggtatggcatagttcaggatctggctgtttttctaaatgcttgagtcttgttggttgtagcagtgacagtgatggcagattatctggatgtgtcaatgtaatcacaagaatccttctactggagaggaaggagaatcaaagtaagaaaagggagacatggtaatggatccacgaagtgggatgatgcactaagttgaaggaagaggccatgagccaagggtggtaggtagcctctagaagttagaaaaggcaagcaaacaaattatctcctgaaatcttcataaataacatagcccaaccacaccttattttaaatgtctaacttccaagatcatcagagtaaatttgtgtggttttaaattatcaaatttttggtaatttgttaaagcaacaatagaaaactaatacactcatttgattcataaatatttgtagagcaactaatatatctcggacactggctggctgttggggataaatgtattagcccattctcacactgctaaaaagaagtgcctgagactgagcaatttataaagcaaagaggtttaattgacttacagtttcacatagctggggaggcctcacaaaacttacaatcatgcagaaggggaagcaaacacgtccttcttcacatgatggcaggaagaagaaatgtcaagcaaaaggggaaaagcccattataaaaccaacagatctcatgagaactcactatcacaagaatagcatggaagtaactgccccatgattcaattaccttccactgggtccctcccacaacacatggggattatgggaaaaacaattgaagatgagattttggtggggacatagccaaaccatattaatataatagcaaatgaaaacttgaagaggagagaatatttttagacgcattttatgaggccagcattactctgataccaaagcctgacaaaggcactacaagaagaaaaattacaggctgatattcctgatgaacatagatgtaaaaattctcaacaaaatagaagcaaataaaattcagcaacattttaaaagaatcagtgatcattatcaagtggaatttatccctgggatataagaatcattcaaatatgtaaatcaataaatgtgattcaccgtattaacataatgaaggagaaaaaccatatgatcacctcaaagatgaagaaaaatacatttcacaaaatttaacattctttcatgattaaaaaaaagctctcaacaaattaggtataaaaataatgtacctctacacaataaaggccatatctgaggaacccacagctaacatttaaccaatggtggaaagttgaaagttcttctatgattaggaacaagaaccccactctctccacttctatgcaacatagcactggaagtcctagccaaagcaattgggtaagacaaagaaataaaaggcatccaaattggaaaggaaggagttgaattttctgtttgcagatgacatgatcttatatagagaaatcctaaagactccaccaaaaatctgattcatatcagtccattagaactgataaacaaattcattaaagttgcaggatacaaaatcaacatgccaagatcagtagcattcactaacaaactattgggaaaaaaagattaagaaaacaatctcgtttacatagcatcataaaaaatatattcatgagtaaatttaagcaaggaggtgaaacacctgtataatgagaactatacaacagggatgaaagaaattgtagaagacacaaataagtagaaaaatgcctgtgtttatggattaaaagaattaatattttttaaatgactactcaaagcaatctgtagattcaatgaaatactcaccataattccaatgacattctccacagaaatagaaaaagcaatcctaaaatatgtatggaaccacagaagaccttgaatagccaaggtaatcttgaacaaaaagaacacagctggaagcatcattttacctaactttaaaatatattacaaagctatagtaatcaaagtggcatggtactgtcataaaaacggacacatttgccaataaattattgtcttatgatatgttctaatctaaccagaaacaccggaataggctgtttgttttttgtatatgttgtatttgatatgtgttttgaacatctacatgggtatagccagtaataatagctaacactatacttgtcattattctaagcactttttatgtattaactcatttaattcttgtaacagtcctgtaaatatataatagttgaggaaacatttatagatgagggaactctggtatgaaaatatgaagtataattaacgtcagatattaacaaatatcaagaagaattaggattaaccagaaatgccttgatttggtatttttattataaaagttttcttttttacattttctgaagccatattgattaatcactgtttcttgataatgtgtcaggtctttacacatatgtttcagcagttaatttttatgttgagtaattttttcagctgtcactaacctgttcatgtcatgggcaccaactcacaaacatacatctcagcttacatttttataatatcctctaagacataagtaatttattctgcttctgctgaaaatttccaaaatgtcatgcccagtgatctccatggaattaattcttgtcatatatttattgacatattacagggttttctatcaccactgactgccacttttcaaaactagaaccattatttcaagtgtcagggtactggttacattcattctctttgatataaacagatattttaactggtagttttatagaaatgttatttttgaaaaccttatgaatcacatatctattataagcaaaattttaagattaagatgatggctattttatctttgtccccttgtatcttggacaagtatatacttagtatttgttgcatgaagtaatgaggtatagaattctatttactaattattgtgttcttaatctgagtaatgagaaattgtttgcaccgtgattacaaattggtagcaaacttagcaaaacaaaaaatgtatcaacattatttgttgaacaccaattatgtatcatcatgctgttcttaaatcaacatattccactgaactttctacccctctcagtaattctctcactaatgcttaattattgttacccatgactccattctttaaacactcctaatacagcactcattccctcagcctcagagaagagtggaccagtcattgtcaagggccatttttttcaatacactgtcaaaggaccacaaatctgctatgaacaggatgatgaatcacatgaatgaatatattctgtaagtttgtgatcacttgattagtgtcagtattccccaataaaataaaagctatatgaacaatcatgtctgtttttacttagcattacatcaaccagatgacaaaatttaagtgcacaaagtatattatttaaaagactgaagttaagttcatttaatttaaatgagggatcatatgttaaatcctaaatgttaaaatttaaaaaaaaaaaggttaatcttatccagatgggaacatagctatttatgctactgaaaacacatgtgatcatcaacccaagaaaaaggcaaccataaaaaagaaatttttttcctcatcgaatcaagattaggtagtcacaagctgaaatcttggttccttctttgttatactattttcctacaaacgtttctttaaatggtcttagaagctgggagccaaaggtttttaaaattgaataatcaccttttcacatgctgtatttgtgttcatattttgtgaatcctctaatgattcatttaagtatttactgtgttctccaggtgggctttctatagctttccaaggcatgatttaaaaatattaaaaataatacaagattttgtgtttgccaaactaaagaagttttgaaaataaaatgtgagactctttttttcccaccataatttctgtttctgtatctaaggccgtttaagtaaacatctaaaaacggtttttataatggtaagagaatcatgaatttcatttacatatttactgttcacatactgctgtgctggtaatggcaaatgcagagtttattcaaatagttgtctttgaaacacatataagaggtcaaagaatatccaggtggttctgagccctttagcagacacaaatacacacaaaatgaggtttcgagatggatttctgaaatgcccttgggctatgtaatgctaaattatacctgaaaattcattctattcaactcagcaggctgaagtagctcatcaatgtagtgtaattataactaaataggaacaggaaaggaattaggaggacaggattgctgtgtataatacttttgtagacaggctgaaatgaattctattaatatataatatttatgcaaattttaaattggaaataattagaaattttggagtaaaaatgttgatactattcttagaaacaaaaatatgctgaatatgatccataaattgaaattgatattttttaaagcccataaagaattacttatcatagtattggtctttgtctattttaagcattatatttttaaactatgaataaatcttcttaatgtctagaccaacattttcaaaattgtttggttatgtgtgtgtatgggcacctaattttctgacataatgttatctctttttaattggaaatttgctctgggtcattctaacctacttgattattttccccgaagaacattctccaagtccataatggaccttagattagtgcaaatattatcatttcagtggacttcatgcaccaattaggctttacttgaatatctttagaatcacaatatatgcacctctagaattctttttaacttttaattcaggagtgaaagtgcaggtttgttatacaggtaaacttgtgtcatgggggtttgctgtacagattatttcatcacccaggtattaagcctagtacctattagttattttttctgattttctctcttctcccaccctccaccctccaaaggccctagtgtctgtttttccccgctatgtgtccatatgttctcatcatttagctcccacttacaagggagaacacactgtattctttttctggagtatgaggataggtaagtatcagaatgcattctctattgaaatctcacatatcaaatatattctcccattgtctgacactttaaaagcatgtatatttgccaaaatgacaataactccaataattccaactaaagtaaaatcctaggtagtgttctctattctcaactgttttctgaatttggtttctttgacaattagttttacaacacatgagatagtggtatcatgaactgggtacagtttttgcagctcacaaacgtacacactccagctctgcttctttcttgcaagctctttgaacttggcccttgaacctcggttcccttatctgtaggatgaggactcctacctcgcatcactgctttaaaattaaagcaacataaacaaaatccctcatacaaagcaagcacttaataattgttcatttttatgattccatttagcttctgcaattaattagggaactattttaattaaaatacctcatctatatttaattcattgcttacattataaagctaacattagtgaactctaggggtgatgatgtaaaattataatatagagtcccaatgataataacatatattctttgaagcagaatatgcaagatatcatacagtggagtgcagaatcccagttcatcgtttttttagcatcatgtatttattacctgcctcacaccaagaagaatttgtgccccactaccacatatataaaataaagtagaaatacaatgaattttatatagataaaacacagcagaggaaagaaaccccacagaatagaaagatgaaaccagatgctctagttcagagtccagaaagaagaaagtaagggcaagtttcaggaaagacagacgttgactaagatagaatcagccaggaaaagaggaaggcagaactctgagaagtcagcagtgtgtacaataggatacttgctactttatgtctctgccttcctctacttcacgtgccacgtgccacttgctggtccccaccattgtcctgagtcttctgtgcttggttaagaattttctctagctacaatctggccactgaggaaggacgcatcctgcaaacacctcagaaccgtgttttgctaggaagctttaccactcacaaccctgtggcttttaagataggtaggtacatagatagatagatagatagatagatagatagatagatagatagatagataggataaatagataacagatgaatagatagatagtagatagataagtgtatacatcctattctgtaaactctttcatagtaaaattctatgcataattttcatgatcacagaaactaatatgacttcaaggatgttttaatttctcatcaggattccctataaactcagtactatcccttcatctcaggacacagtggagatgctctgagacaaaagttgtgagctgctgaggaagtattttttataagtaaaagatctctagggagcatggtacagcaattctcccacatcatgcttgtctagtccactcggctgttataataaaatgccatacattgggtggcttataaacaacagaaatttgtttcccagagttctaaaggctgggaaatctaagatcaaagtgctggcagattcagtatcttgtgagggccttctttctggtcaatagaaggcaacttctctttgtgtcctcaggtggaagaggcaagggatctctctggggtctttttaataaaggcactaatcacatttgtgagggttctgctcccatgacctaattacctcccaaaggccccacctttaaatacatcacaggagggattaggtttcaatgcactaattggagaggaacaaaaacatttagaccatagcaatgcacatctccaataaactatataatcacttccatatgtctgtgaggtagtttgttgcagatgatagtaccttttatgtggctatcatccgaaaagagaccttgtacctttttaggttcaggattattttacgttatacctttaaggtaaaatatagccaacatttattaaaaatatattgaagggaggtgaattatttacataggcataagtaatttccttcatacttttaagtataatcgctaggaaattaaagacatttttcaactcttttgtaaccattaaatacttgaacccatccaaaggatatgataaagaagatagaatttcattatccttaaaacactgcaaatttatccaagtataaatgagaaaatcaggcaaccaagaagataaactaagtctggataatcaaatttaggctacaaaaagataaaactcagataaaattgaaaggaaagcatatagagaaagagaagcaacaaaagcaagaatgctaaaaaacaattaccactaaggagatgcagtaaaaataaaatcaattgtaattgtagttataaaggataaacattttaactgtttaatacatgtaagtattaaatatttcagaatcataataattgtaaagatttctttgacattaatgcataggaaactggacaaagtccaaagaaatgaataaaggcttaataataaaacccaattatagtttaaaaaaaatgaaagtctcttccagatacataaaaaaactgaacaaaactaaggagtacagaattgatttgtttgcttatttcacttttagcaacagtcaagaataaagaagcatctttctggaaatcgttatttttccctaatttgaaccaataccacaaatgaaaacttggaccaaacttaagaaagtcttttatttccttcaattcaaaaaagaacaatgataaataaagtaaaatgaggtgttgaatgaaatgacaagatgtttttaatatgatagccgttaaatattttagtaactatttttagattatctacttacaggacagcacttgacttggggcgaatggatgtgggtccagatctccagacagttgtcaagacagcaagtaatttaatatagatgagtgtcaaagatacagatatatatttgtttaattgctgaaaagatgggttggtgattgtgctggggttgaaaattatttggttgttatccttgaaaaaacctgaggaaagtattcatataaagaattcataggaattgtatgaatagggaggtgtttcaaaagaaggaagaatttatctctaagaggagaaaagccagtgttaccacaggggcagctgataagataaggaggaaagggtaagagaagggtcccacccatacatcaggggcgctgggtgatatgaatgacctaggagaaaggttaactgtgagtaactttacatctaaacctgataaacattttctgttcctacctgagaaaggagagttgagatatcacttcctatcactcttggaagccctgattgaagcccctgctgggagtacatggtccaagttgcatgagttcatatacctcatcttccttcagttatcttttcagcaaacttgtaggagctgtctggtctctatcggacatctgtaaatgaagaatttgggcaacagaactttgctgcatcttttcggttttaatatttaattattctagcaattctctgaaacggaaccatcataaaattcaagttaatgatttctatacactctatatacagtgtcttgacaaaatacttagaaggtttatgaaattcaacacgttttaacttgaaaaccagataaagatgtcaatactccgagtgagctaataattcgatacatttgatcttctggaaatatccagttagggtttcatttggaggaaaggatgagggctggaggatcaggaagagagggggtgaggtgactccagtaagacagggtactcacccctgctgcagagctgagaaggcctgttctgtcatcccaagtcagctctggctccaaacttgaatgtccctgccgggaagccagaagccctgcagtcaactggattcacccctcctagaaggtagtttagcacaactagttgttgtggaaacatgtcccttgtggggtgtcatctcctgtttcctgcacaactactcaaagtatcccttcacctcacatggcatgttatgttgaactgtctctggagaaatattagccagattttaatcaggacactatgtctcgccctctgtgacactttattcagacataacctcttagcttcactttactgaagcatcaaataagaatgatgataagaataataaaaatgaaaccaataataacaatacgtacatcataggactgttttcagtgttcaatgaaataatgcatataacatttagaaaagacctcagcacctaatgaacattctctaaattttagctctttttaaatcacacagcattcactccctgtgtcacattctggcaaacatgatgtccttggtttcagtacattactagtgacaccatagagcccttttaggtaagtttcccctagaagctacccagtgcattgccacttaattcagccctaaatcatattggcctagttcctggtaaaatgctctcaacacaactatgtaagtcatgctgtgtccctgaccattacctctacgtgttctcatttggctaaagtttccccattttcaaaattgggatagagatactcaagtaacagaagattatgtgacataatgtatatttagcatagggctagttgcatagtctctctctctctctctctcacacacacacacacacacacacacactcattctttccctttctctcttcctctttccctctccctcctatctcactctcccctctttcttccttttcttcctctctctccttcctttcttctgttattctattactgttaaaaggacagtttatattatacatttatattaaaagtatatatcttataggcttttatttctactgattccttccatcaataaatgaaaggtatagatacaattatttgatttttaatgagaattaatttatcccaatgtatcaatgctcactagatttgcattttaagtgtggagtataaagattcaatttaagtaaaagaaaaacagattgtagggagtagatgaggagaatgtttgttaattaaggcataaaactgattttgcaaacaaaacaactctagcccatttgggattcttgaagagggcaggaagaagagtggggtgcctggacgtgcccttctcttcagcttctctctctgtcccttatgtctatattttttcttcctacttttcggaatgaaggttccccaggttccactttcaccaaggactctgctccccctcagccactgcccctgcctttctctcacctgcctaccctactgcagcatggtgctcatgaagttggcttgtattcaccgggtatatgtaaggtccccaatccctccaagattcaagccactaggcccagatgtgaggttcaggagtagatgctctaaatgcactgaggcgagaaaagtaacataagaaaggattgaggagctggaaattgcctatatggagcctaagaaactcagccctgatataaggtctggaggagaaaggtgggccaaacattgacgagtacaagtctggctgtttgttttagtgtgtatctgtttatatatacatgtggattttaaggtgtataggtgtgatgatcgatgaggctggagggtgggggcttcttgtacatatgaatgaagtgaattgtcacatggtctttccaaaaactgttcagattgatattaattatacataatggagaattaaaagtgtgaaaagtgaaaaactacaaatttgactgtatataatcaaatagtaatgctaatatcaatgacatttgagtcattagtccattactgcctaatcatcaccacgtttattcatatcataaatatataccacctatatactgcctaaaacagaaaaactgttttaattctattgaattgccacagttttcgtgccttgttggtcttatggcattggtgtctaagaaatcagcaaatagcttttataaaggagacattgcttattaaatatggctttgttcctgtgaatttaaaatacatcattagatcttcatacctgtgaatatgtacaatttcatcaaaatctatatactgagaactcacgtaatgagagaatgcattcaaattaacactgggactaaaagatgtgaaatgacaagtattttaattatataaaaaagttactgtagtcaataaacatgaattggctcttgtctaaatttattgaaaaagaatttgtgattgtatggactttatcattgaaacttgtttattaaaatttattcatggccgggcatggtggctcacacctgtaatcccagcactttgggaggccaaggtgggcggatcacctgaggtcaggagttcgagatcagcctggccaacatggcgaaaccctgtctctaccaaaaatataaaaattagctgggcgtggtggcaggcacctgtaatcccagctactcaggaggctgaggcaggagaatcgcttgaacctgggaggcagagtttgcagtgagcctagatcgcacaactgtactccagcctaggtaacagagcgagactctataccaccagccccccaatacacacagacacacacacacacacacacacacacacacacacacaacaactcatttattccacaaatgtttattaagagcctactttgtgccaggcattgatctaacctctggacatacatctctggaaaaaaaatgaagttttatcctcagaaatgtatgttctaataggaagagaaagacagcagtggaatgtacagtaatgcagacactgactatgccctaaagcaagatataaccataggggtctttgacaaacagtcttaccaaagagtttagttcatcaaaagtcaaggacactgaacagaatattgctgaaaacttatagaatattattcttggtatatgtggttacaaaatataattatttaagtaaaaaaaaatcctttacactgaaacaatgcttctatgaagagttatggagatgatatttcccgctactagtaggtagcctggatttgttcacacttaaaaaagaataactttgaacagctgagtatctccacttctgcttcttggcaaaaaggtgaaacttaatacataacaaggaagtcttatgacatagaaatttttcactagcatgtgggtccttctgtattttaaataacaactaatttcagacacccaagtcagcacccaaaggtgtctttgaaaccatgttctcatttggagtgtttgggagaggcagtgttcctgggcttctgctgaatgccaggcattgctctcagaaaaggacagtacaagctataatgaaggcagagcttccaccttgtccacttgagtgacagtgtgaaacatattcagatagggatatgccccaactactgtcaaagtagagaactgaggactaaactgaggccccaggggttgggggtgggggaagcttctggagaggcttcttgcaagcaggagcagagtgcctgctacatagtaggcactcaacaagcctgagaacctattgtgtgcaccttctatgtaaagttctgtggatataaatgtgaaaatgtgcaatttctgttttgcctgagaagtatagactggggaaatagacaaaactaaaattgagaattgctttaataattgaacatacaaagtgtatcagagattctcagaagaaaagaatttagcagagtttcaaaataatatacaaatttcagtattctatagtggttaaaagatatatgaacctaatttttaatttatataaatactaaacaaggtttttatatttagattttcagttttgcaattcttgctaaatatatgaatctattcttaatccaacattgcttcatggacagcagtttagtagtacagatttcattagagaacttaactgctataggatcgggggaggtgaaggaaatacaattttccctagaagatttacattaaacagagtagttacaggctgtagcatctcccctgtaattttatgagaatggtattaccctggctttcactgtgtgattgctggttaccttctgtcagtgagcaacagtcttactgcaaagcaggagcacaacccgtctctttgtctccgtggtcaaatcaattacttcttagaaagtctaatttttttcaaaatgaccatgtacaagagcaaacgcagacatcagagatgtaagtaaaatctgacccaactttttcatatcactggggtagggaaaacatacttgatttcttaaaagactaatcatgacttcttcagatacatcctggtagtagaaaagatactgtagcttttctcaccctaacctttatctttattcctgtaacatgcatgaaagatgttgagggcagaggggataattcgcttgttaccatggaaacccttggaaaggtttacaaaatcaacagagaaacagatcaaatgcaatttcagtctagctcagcatccttcattcaggcatgatcactggacagttctcttttttgcttttctaggagtgatagattttctttcctggaagtctattgaaaggtttgggaagctagcctaaaacttctcgttattcatccaatttcaattacaactcttagggagtagaaagcagttcagaatggaggggagagagttaattgtgaatgacaagctaaatatttaacaggatattcattgccaaacttcttggtccagagcatgctagtgacataattcactacaggcaccatttcaaagggttaaaaggagtcatctgcagtcttccctaaaggaactgattctggctgaaaaggagcagcacaattaccctggcgtaaagtccagaacaaagattattatggaactgaaagctatcaggatcttgctaaaaatcaaaagattgttataacactattttacggtaaagcaatatgcctctcaagaaaagctttacaatcacctctctctagtaagtttaactctttatcactttatcttttctattgtctaaagtaaataataccatatttagcccaaaatggtctgtcactgtctctatttatcgtcatagacaggtaacggcaacttactctgtactcaaagtctgtactttttcattatttcttttgatgtctttaaatgttatcaaatattttgaaaatcaaagtctatcagtcacaattatcctatcaaaaagccaataaatcatataaagataatttttagtgcgataatttattctttggtctgttttcacctaagatctgaaaactaacatttctcctgttcaaagaagtttcatgcaccacagaaagctctgagggctaggctgccagtttgattctgcaagcttgattgccttttgatgccagttctttcttgtgataaagaaacaatatatgataactgctacttttttcaggtaaaaatgattggtgtgaagtctacacatatattgctgattaattttcttgtgatttcctcttacaagaatgaatctaaattatgcatagatttgaaaaccatcttgtgcctttactcctgtatcttttatatatccctcattttttttccttgtggattatcaatgccttaatgcacatggaaaataagagattcacagaaaaattatactgagtgtctccccttaaaatgtgctcactgaagtctgcgattaagcagcaggaagaaattgtgaattacatgagacaagtcagaagatgtataattatacaggcataaacacagtagggtgtactggaatggttcagttaaaaaaactaatgtgttacttaaatttaattgtatcaactattttatgttgcattaagtttttctatattctaataatataaaatatcagagagcaggaacataataaaattaaagtatatagaaagcttagcaataaaagcaaatagaatccttaaatgaatttcttaaactaacaatatttgcaaaagtagaatgtaatacaatggtttgcattccaatgcgtaaacagaaaaactggaattttcccatcaccaaaatccagggcatttccattttcagtcatatcttttatgcgtgggtttttgatcatataaaaggcataaacttacctagaggcaattgtaatccaattaaggcaataattgtacattcaagaaaacctcactgtaggaaagaaggaaagtcttcttacaattttctttaaaaatgagatagtacataaatcaactttctaatttttctcattatccaaagatttaatatggtatcttttagtaaaaataagtgtttcctttcagaggatctgacaaaaggaatagtaaaggtgcatgtggctatgtcaggagtttgaggaaaaaggagagaacaaaaatacttatgagagagattttaaagtacaaattgtactaaacctttgaagattcatgtggggctttgaaattcattctctactcatattgagattagttatttataattcactatacaagaggaggagagggagggaagagtgcccattgccttgcttctgatagtacaattgctaggtaaaaggaacagcttagtgttcactcaaatagcagatcttacttgtgcaaaactgcattaaatactttcaactgtatacagaatattttgagtggtattaaaaaatgtttgcatatatcagatgctgatattgccagagccaaacaggtacagaccaatttaaggaattctaatacatgcaaacctgtttttttaaaattcggattgatttgggaattaatgtttaacttttgagtccatttaaatactaagtttttatacatatataataacaaaatttatttaactgtgaagtttatgtttaaattttcaaaaatttctgtatacaacaaggaaaacctgtaacctcccttgctgaaactccacatgaccttgagaaaacatttttggagttttataaaagacacatgaaggtacatttttaaaaaatgaatatgtttttaaaacactgacgtagaggaaaaagtagagtagaagccataggattttgaaaatagcacaatacctgtgccatggcaaagaaaacagtgtgaatcgagtttcagatatgtaacatttcatcttattttactgaattggaacagatcatgtattttttattcctaataatatctttgggtgagcttatcgaccttatccatattatcatggaaatacttgagatcacttcagaaatctaaatactagtcatcatagccctcttcttatagtcttggccaattatctattatttctgtgggttgcaatctcttctgtaagtttagtagattgcactgagaaagtgttctgtagggtaccttccatctctaaccctcattgcctccataacacaaccctcatcaggtcattcccctactcaaagacattaatggtttctcattgactagataatggtggctctgggcttgtgtgcttcagatccttgggtgcccatggagttactacaaggttactacatattaatatttacataaatatgaatcattgtataatgaagaaaaatatatgtgtatatggacatacacgtgtatatatacataaacatatacatacatatatgcttttaaagttctaaaatatgtttaataaaaacaaatgtatttaaaaggtggtgtactgcatttgtaatagctttttataccatatattttactttaaaaaaaaactatagtacatgcagccctcattatgttttggtattcttttttttaaaaaaaaaacttcatactcccgaaggttgagaatcactgaactagaaagtgagtacaagcaagaccttataatgtagaaatttacatgattgtcatctgcccactactttcttctcttcctggtaccacctatattctaccctttatcaagctaccaattgtcagccaggcgcagtgtctcatgcctgtaatcccagcaatttgggaggccaaggcgggaggattacttgagttcaggagttcaagaccagcctgggcatcatggtgaaaccccatctctactaaaaataccaaaattagctgggcgtggtggcagacacctataatcccagctacatgggaggctgaggcacaataatcgcttgaacccaagaggtggaggttgcagtgagccaagattgcaccactgcactccagcatgagtgacagagctagactccatctcaaaaaaacaaacaaataaacaaaaaagctacgaattgtccttgaaattcactatattctcttatctctatgcctttgcctatttatcttcttgttgatagatggccttcacctgcaccttcacacctctctgttgaaggtttcactcacatgccacatccttcctaaatgcctctccagtttctaagtcaaattgctctttcccttctatcttttcagttcatatatttttgtttgtttgtttgtttgtttgttttgagacagagcctcactctgtcaccaagctggagtgcagcggtacaatctcagctcactgcactgcaaactctgcctccaggttcaagcgattctccttccacagcctcctgagtagctgggattacaggtgcccaccaccatggctggctcatttttgtatttttagtagagatagggtttcaccatgttgcccaggctggtcttgaactcctgacctcaggtgatctgcctgccttggcctcccaaagtgctgggattacagttgtgagccactgcactcggcctcagttcatatattgtaatttttcttaaaatttctatattctgtcttatatatagaaaattatctatttacaccactaatctctaagtttctttcatataaggtattctttattcttgtttgatacattctcagtgcataatatgatgctttgcccatcaaaatccatggctgtctaatgaagtttatcgacttaaatatatatttttgaccacctactactttccagagactgctctaatggtagggctatagcaatgagcaaaacaacattttattgaagataagatgacacacaaataaatatgtaatatgctatgtaatgctaagtgctatggagaaaaataaagcaagtaagggagaaatggagttttggaatgtggagtgaggaatttctattgtctatggggaagtcaggaaaagccacttactaaggggacatttgatcagacaccctaaagaaggaggaaattggttcagtttctctctggatagttacaagtagaaatagcatatgcaaagtccctgaggaacattgggataattgaaggaccaagaaagagtccaataagtagagtgactaaagatgaggtcaaaaaagcatgaggaacattggatagatagagtaggacagacaacagattttaactgaaaagtccatttcatttgtaactgaattaagacataatatgtatatactaacttttagaaatcactatccatatttctaagtgacttgtgcaataatttttaaatgacaagttttaaaagtatttttaaaataatcactctccatacatggcaaggcatgcagtcattgactggaagacaatcaaattttggtcatccagaagtccaaaagatattgtttgaccaggaatattttctgacttatcttcttataaatatccttgtattctttattacaagaattaaaattaagtctacctctctttaaaaatcttcctatgagaaaaagtaaatttacattttgatagaattgttctaaggctttttaaggcattgacagggaaaaacaaggctgttgccagtctcaattgatgtgtaaaattggtctctcagtgatcaacagtgataataggtttgatattttgtaatttttagaatatgacttgtcttagcagtcacatatttattaatgtgttgtgttttatagaagtcttgtttaaaggtacttattgaaattgattacaaattaaatagcaatataaaaatggattatttaaaacaaatacttatgttgataccatgatttctttgtaactgtgaagacagaagaaataatttgttattaattcccaaattacttcatatcttaagtgttgatcttttttgttacctaacgagttgaaaatgtgatctaggttttaaaactttttttaagtttataccagaaaaaacaaactatttttaggcttgattggtaaaggctctctagaggacactattaaattcaatctttgatttctctattattgatgcttgtagggaattctggtatgatatatgcaatgtcttcagccctttttattctcaagttctagtatgaattctataactggtagaaattgagaaattgtaattttatagattcctccatggaatcacatgtgcatggatagaatcagtgcagtctgaatgagcatgcacaatgggactataaatgccagtttgggagcagagacgtacaaaggctgactgataacaccccgatacagattgaccttaaatggaaatgcatattggtctgcctcatatccttaatcacaggcttttacaggctccagcctgtgactggttctgcctgcagaaatatattatctctctctctttctctctctgtgtctctctcagaaaaaaatctgatgatattcatgtatttttctgtttaacaatgccccacacattcaaaggtcacttttgtaccaggtgagcatttgtccatttctctcctgtactttcagaaaacaacttgactatcatatgtcacctgctcttttaatttctcttctaagaatctgtgctgcatttatatctacacttgcataaaaaccgtggcatttactctgtccccaggtgtttaggtaattgttttctgcagagtatactttatcacttcaaaaaatgttacagttaaaaaataatgttaatttgtatctgttgataaaagaattatacatgtgaaacaacaagacacttaggaaaataagattggtgttaaatgaagatattagtctatcattttaacatactgtcatgtggtttgcaaacattttcttccattccatggttgtctcttcactctgttgattatttttctttgctgtgcaaaatctttttagtttgatgcaattctatctgtttttgcttgtattacctgtacttttggggacatatccaaaaagttttggctcaaactaatgtcaagaagcttttcttctatgttttcttctagtagtttcatacttgtaggtctcatatttaattctttagttcattgtatttttgtatatggggtgaaatagagatcaaatttctttcttgtttgtatggatatccagttttccaacaccatttattgaagagactatactttccctattatatgttcttggcactttggtagatcagttgactaaaaatgcttagatttatggctggactttctattctgattaacatattttcaatattaaactcttcatgtatttttaatattaatcataactcaaacagctcaatagcaataaaattaataacttgattgaaaaatggacaaagaatgtgaaaaagtcatatctcaaaagaagacatacaaataatcaacatacatatgaaaaaagttcaaaatcactaatcatcagggaaatacaaattaaaaattaaaaccacaaggatatatcacatcacacctgttagaagaattgttataaaagtgtcagtgagtacataaagtgacaacaagtgtcagtgagtacataaagtaaagggaattattttacactgttggtaggaatgtatattagtacaaccattatggaaaacagtgtgaagtttcctcataaaataaaaatagaactaccaaatgatccagcaatttcatttttgggaatatattcaaagaaaataaaattaattatctcaaagagatatctctacttccatttttatagcagaattactcacaaaagtcaagattggaatcaacataaatgtccatccacagataggataaaatatatgatatatatatatctcatataatatataaatatcatatctcagacatatacatgtttcatatatcatatatatcatatgtaaatgtccatacacagatgaatggattaaaaatatgattatatgagatatatgtatctcatatagatacaacacacacacacatactcacacacacacacacaccccaatggaatactattcaatctataaaaagaaggaaatcctgtcacttatggcaacatggataaacctagaggacattatgctaaatgaataagccaggtacagaaagataaatactgtgtcatctcactaatatttggaatctaaaatagtggaagtcattaacagaagcagagagtagaatgggggttaccagaggttaggtggacaggaagggcaatggaaacatgtttgtcaacagatacaaaattttagttataaaagcaatacgttcaggagatctattgtgcaacatggtgactacagtcataacaatatatcatatgcttgaacattgctaagggagtagattttaaatgttttcacaaaaagacatggtaatggatatgtttcattcattaagttgacttagccactccacaatatgtacatatatgaaaacattatatatatatataatttttattaatcaataaactaaaataaaatactgtcatgaatgcaagcagtttgacatgactaaagaaaagataaccattcataagcatcaatgcagtgtaggaagtagtgttttctatgctctaacatatgccatctttgaaacatcagaaagcaactttcttaaaaaccatgatctgtcataattatgtgttttgggaaatctttttggttgagcaatatgaaatcaccagttttgtaagtcaatggttaaatctaataaataccagctattgcataagtgggcaagaaaaggggagaggtgggtataataagccattatgccagcacaagttggcattaaaagcatagggctgttacagttaaccaagtgtgattatgtaatacactaaaaatatctaattacattagggaatatatgcattgttgctctttaggatatataaggttaaacttcctacaaaaaaaatgaaagtatgttcagtgtcatcaacatagattaactagatgactttattttttcaagtgacatatcagagcttttctagaaagtatctaccttcaactaaacttacaatgtttattataagcatttgaattctaattttacatattttatcattaaaactttgttttcatccaaagggaaaattgagtagttctaaatgaattgggtaatgataataaaattgacaaatatattgaatgtttaccatatgtcaggcactgttttaagcattttgttatagatgactaatgtaatttacataagagagcaataatcaaacatgtaatagaataatgaagtaatttgtgatacttcatttttattataatttcaaaatgttatttatgattttatttctaatctctaggaaattggacacccaaaattaaattaaaatatgaacattgagtggagttaaaaagcaaccttatatatctcctaaggaatctaataaattaactttaaaaagcaaaatataagttttaccaatatccctaccctttaaatcatatagaaacagaaaaaatatcttgaggaaagttttacataaatataggcaaacaaaatatctgcaaatgaatgtatttgtctcatatgctatcttttctgcaaaggaatgaaaggtttccagaacttagaataagtgaagttctctgcagtgattttagtaattcattgtgaatcattacacacttcttgatctagaacagctaagttgtttggcataaccttttgattcattttcctttttctacttattgattttcttagcactatttactgaattacactcttattctaacaatggaatttctgacacctttagttatataggaaaacattatatgtgtgtaaatattgactcaaagtattaatggtctcttattattgacatattatctctagaacttcatttgtatttaaaataaaaattatgtccacatttatttccttagactccgtatagagtatgtggcatatatttttgtaatgttccatgccttgggctacctatcattggaaaatgttatatttcatattagacgattcttttgacccctagtaaacctgaaactgccttagaggaacagctgaatgtatttccttaaataaacacattgttcttcaaattgctagtgtttgtcttcttaataggctccacaggcaatgggaatgttgactttgaagtcacctctactgggttcatgtagataagtctatttcataccttttttcttcccacacttaacagtgtctttcaactcacgtttgttttaagacaactataaatgcatacatactacatggaatatttaatttttatttaatttatagtctcagtaattagtgagaggttggctcacaattacataaaaataaacttagacaaaaatcagaaaaggtttacttttaattgaggtatgaggaaaaattcatttacttggtcacatgcttggccttcataaggtagcaaaagataaatggtcacttgcattgtataagtggtcgtaaaatttttctcagcactgaactgtcctccagagctatttatatgaagctagtcattttctaatgatcacttgtaacatagatgatacactcaattttgataaatgggtccaaactctcctaaagaagctgtaccagtaatactccatgaagctttctagagtttgtttgcttattcactatccagacagaaatattttgcatatttttcaccatcccagttttcaagaacccaagctagagtttgagaaaattctatttgaatggacataaaaatttatttgattttgaaataaaaacaaatcattaaaaattctactttaaaaatatgctttgaaacttgagtatctaggaaaaaagttaataaccaagcacaggaacaaaatacaagaaattgtagcataaagatcatagatatgctttgggaggccaaggcgggcagatcacgagatcagaagtttgagaccagcttgaccaacatggtaaaaccctctctctactaaaaatacaaaaattagccatgcatgatggcacacacctgtaatctcagctactcaggaggctgagacaggagaattgcttgaacccaggaggcggaggttgcagtgagccgagatcacgccattgcactccaacctgggcgacagagcgggactccgtctcaaaaaaagatcatagatgtgtttgttactatgattctctttttggtctctgaaaatgggtccctggaaattagaaccatattaagttaaccatttcttatatattagaaacagttgtttatcaggttaaagatgctatattttttgtactgtataaacagccatctaacatagtcatttgtttggggaagatactagcctttgataatactatttctcttagattactactggcagcaattaatcaacagttgtagtaatttaccctatacttcaagccaaattaacagtcttgccttgcttatatgaatattaaaggataatgtggcattgggcctggaattctcagtaagttgcccacattgttaatatttaccaatattaacttaggaataggctgcaaggtgtaaggaatgtctgttttaatattcattttaaaaatacatgttttaaatattgtaattcagtgtaatcacatcagttatgataatttcattttgggtccaggataattaaatctggaattgcataagatgcactacaatggtaatattatttcattattctttgtaactaacattccaatcactggtatagattgacatttggaatatgactatcatcacacaattctttgccctaggagacttcctaatgggcattttttataccttgctgtagccttttatgtacttaataaccgtacagtttcatgtagcttcataacaaataactatcattgccatatttatgtggtaataaaactagtttaaggtatttttatgaagctatttatggcttttagtcattattgagttttttatgactattataaagtggtatggcttaagaaaaattataaactcccctatgggtatttgtcatgattgaaaataatagaattctttttgttgttatgtcttgggaaattttattatcttctgtctagaaaagcaaaatactagggatcttcaatcagattattaccaaattattaagattttgttctacgtattgaatgaaagcatatattccattacttgtcccaattgaaataaacataaactgccaaatttcctggaaaacagtatatctagaggtcatttcagttgttaagtatgtgttatcaacttaaggttttattagttgctccttgtaggtattctgggtcagtttcattattatttactgaaagcattaatattatttactcatacaaactctatttcttagttgttatagtaaagacagattttttaattattgcataaaattgtatgttaagaaacattctctggccgggcgcggtggctcatgcctgtaatcccagcactttgggaggcctaggtgggcagatcacctgaggtcaggagtccaaaaccagactggccaacatggtgaaacctcatctctactaaaaatacagaaaattagctgggcgtggtggtgcatgcctgtaatcccagctgtgaaggaggctgaggcaggagaatcacttgagctcaagaggcagaggttgcagtgagccgagatcgcaccactgcactctagcctgggtgacagagtgagactctgtttaaaaaaaaaagaaaaagaaagaaaagaaaataaacgtctaattttatgacttttaaaaagcaaggcatttcttgacctggtattatcttactttgaaggttcatttgttgacatctcaccttgcatatttcagattagtatatgatactgaaaattctttctgttctctgaagcactctttccatcattcatacattatgttgtttccatttagaacactctcctctcctcttgtctgagctaattcctactcatccttcaggtgccagcttagataatcacttccttctgatacatttctctaagctgctggtggctggtagagtttatctttgttatggattcctctgtaacctgtatgtattctgtatgtaattgataatttatctagtcatttggctataacccccaaagacagagatcaggtcactattttcattctatatccccagcatggtctggcctaggaagccctcaattaatagacgttgaaggataaacagaacggattgccttatttatgtacctgttgtagcaactagaaattttagtcatttgccccaaatatgttactatgatataggctgtttgtgaactatctcttgcctttttatattcacagatgtgtatgcatgatatcacctgccaagtcctttttgttctcaggttttggagttactttttctactgacaaccctaatttccttatttgatgagaagtatgaaaaggaatctaaaaatacttatatgctgggcaatttaacaatgtttaaggcatactttgaaagtgccatgaaatccatattataattttctcacaagccctattgttgtactaattattaagcaatgatactagtttctagttaattcatggcttattttatttattatactttttaaaaattgacataaaaattgtacatatttatgggttacagtgagatgttttgatacatatatattggataattatcacatcagggtatttagcattttcatcatctctttgtggggagaacattcaaaattctctcttccacctattttgaaatatatcatgcaatattgttaactatagtcaacacaccagaacttactcctcctgtctaactgtgaccatatatacagttaatcaatctctcattataccccagcccctttccactctccaatctttggtagccacaattctactctctacttcaatgagaccagcatttttagattatttatataaacgatatcatatttgtctttctgtcctagctcacttcacttaatgtagtgtcctccaggttcatgcatgttgtcacaaatgataggattccaatcttttttatggctaaataatattccagtgacatactgtgttgaaatagaaaaaaactcatcttaaaaaatgtgtatggaaccacaaaaaacccaaatagccaaagcaatcttaggcaaaaagaacaaactagagtcattacactacctgacttcaaaatatactacaaaactacagtaatccaaacagcatggtactgtcataaaaatagacacatagacaaatagaaaagataacccagaaataaacctgtatacttacagccaactgatttttgacaaaaatgtcaagaacatgtagtggggaaaagacaacctcttcaacaaagggtgctggaaaagctgaatatgtacatttagaagactgaaactagacctctatccctcactgtataaaaaattaactcaaaatgtattaaagacttatgtactataaaaagactagaagaaaaataagggaaatgccttatggcattggtctgggcaaagattttttgaacaagaactcaaaagcataggcatcgaaagcaaaagtagaaaaataggatttcatcaaaccaagaagcttctgcacagcaaaggaaacaatcaacagagtgaagagaaaatctacagaatgatggagaatatttgcaaactatacatttaataaggggttcatatccaaattatatgtagaactcaaacaactcaatagcaaaaaaaaacaatgtgattaataatgaacaaaagatctgaatagacatctctcaaaaagagacatacaaacggatagcagatatatgaaaaaattgtcagcatcacttatcatcagggaaatgcaaatgaaaatcacaatgagatattatctcacccagttaaaatgggtattattaaaaagacaaaaggtaataaatgctggggagcatttggagaaagggaagtgggaatgcaaactagtacagccacaatggaaaacagtatgaagattccttttgagactaaaaataagatggggcaagatggctcagatctgtaatcccagcatttcaggaggctgaggcaggaggatagcttgaggccaggagttcaagggaagcctgggccacatagtgagaccctatctctattaaaaaaaaaaagaaagaaagaaaacaaaacctaaaaataaaactaccatgtgatccagcagtttcattactgagtactggttatatacccaaaagaaatgaaatcatatgtccagagatatctgtattcctatgtttactgcagcactgttcacaatggcccaagatatggaatcaactcagtgttcatcaacagatgaataaacaaaatgtgcagcatatgcacaatgtaatagtttctatttaatttaaagcttccagattattttatcattttaagaaatgaagactcatagctgataacacgttcagaattaaaacttgtctctctatattctgtttcctcccccatcaagggttgtctctgctgctaagtgtctttattccttaaatcaattttgcatcagttagaggaacaaattgtttttccacagatttgtagccattaatctcagcagtaactcagtgaatattttttttaacatcaacatcagaaatacatggacagaagggaataatttgaaccaagtccaggacatactggctgaatctatgaaagttaagacttcatgtcatataataaatctttgtcactaatttatgctactttaaaatttggggatatgattagaatggtcatataacataatgcacactttcttactctgttctttcattgtcttctccattattactgctactcagtaatggtatcaactggaaattcttgaattgtaagtaaaaatgacctcatttccgaagcatttaaagttattgcaggtgaaagctctctcaagggctttcagtgtttcaatacgtggatgtacaatgtctgtcaataatgaatgccacacattaaattaacttgaatagttatagcccaaactttattctcagctttggcaaatttctaacataaaagcttagaatgtaagaattgaaaaaaagctattagaataatacagatactctgaaaggacctctagattgctacacatatttctttcttttctgagtataattgagatttccaaaaatttttactgaatgttcattttatattctggacttggtaatttaaaaaaaaagataaaattgttaaaagagcaatgagtaattcaaagaactgaagacaaaatattgtatggttgataaattcatatcaaccttcttagctgagatgattagaacaccagggtaaagtggccaaggtcatagggttgagctgtctgtggcccaggtagtttatcctctttctgggtcacagaccattttgggcactatgcccagacattctttaaagaaggacctagtcccaacacaacagtggatgaaagagggaaacaggtcagggccaatacacagctgtcagaactacaatgtctcaaggtcagtatattcctagagtgattttatatatatatatatatatatatatatatatgtatgtatataaaatattgtgtatatacatatatacaatgtatattgtatggtatgttttgtgtatgtgtgtatatataatattatacatatcactctagcaatatactcactttacatatggatacacataacactagatatatacatatatatatatagtgtgacaattttgtataaaaaagggagaataactgtgtttgaataacaattatttgtttttgttttaatttataaaggcagtaaaaatcaaccaggttcacttcacttactttttgagcaggtgtcaagttcacacacttgaaatttcacaggacacaaaatatctacaatttcaaaaaaagcttgcttcactgaagtatatgaaggtagtcccaatatttttcattatatccttgcatgcataagtaaaattttagataatttaaaggacattgaaataattaagtatgctgttgtcttttctcttgaggcatcagaatgggtgtaactaaatttatataggaaacttgactttgttcaccatgaaagaaccgaagaatctgagatttgttttattgaggaaggcttaggcttggttcaggccctactgtgagaagaattagtaggaaaagttccagctttatctagtgagattgacattgtgtcatggcatctttcttaatttaataagtataaatcttacacctccactaccagtgcagtactgacttactgtcgatttgaacctaaagttatcacatgcatcacacttaatcatagtggttttcataaacttaaattcagttgggcagaattctctggatatttatattgattctatgctccagtttttataaacataacccagcaatgacatggaataaagcaaaaaagacttcagagttatcgaagctaaacttttgatttcatagaggaaataggtttgttctattgcccaccagaaatggtgactaataaatgtgtctttccatctttcttctatgagtaactaggaatttcttcagcattagttacttcactttttttagaaaaggaatgttgtcactgaaaagttaagatttaataaagattcacatgagaatattcttctcttctgtttaacatcaatctttaagtagttatttttattattgcaatagtctctcttcctaataagtcatttttttctatactcaccattcccccacccaaacctctaatgctccctcattaccctttattctattaaaatgcttatcatgctgtaaattatatttatttctttgggtcactctttccagtaaactataatcattaagagtagttctgttacctttgcatcaccttatctggctctgtacctggttcatagtaggatctcagtgagtatttgatgaacaaataaatgaatgaataaatgaatgaattcagtaatattgttgagtctgtttttattatacttttaaaacttctgcttatattcagtaatgaaacatgaagaaattaaatcagatatttacctttactaataaaattgtaccagagggagccataatattattgtcagtttctaaaatgtgcaaggctacaaagggtgaaacctctttgaattaatgcctcttaatggttggaaatttaatcagtagtcttcattcacaatttaagaactttacattgtctctctttcagtaacagtataaatgacaactttcatatctgaatcataaataattcatcatcatgtattcacccctttagagtgctaagcataccatagaggaatctttgttaaagatatttggctagccatctacttagttatgttagaggaaaaatattcaaagctcttgacctagtattccaatttctggcaaactttaaaagtaccatctttgacattcatttagaattcatctccttgatcacttttggcccacagtcacaggctttgattcagaacttctaaagcaactttgttttgacctctgctctgttattttccaagtcattttaaaaccaagaccagaaaaatatcctgcttcatattttatcaaagttttcaattatcccattggattttatttcatcatcttccccacactatgtacagtaagttgtttaagattttgtaggcaaatttctcatttccatagaatttgtgcttagaaattcaccagataatcatcaaatcaatagtccttaattaaatactaagtatatatactctttatttttcacaatgcttaattaatctctccaaatagaatacttcaatgctatgttcatcatggaagtaataagctctaagaatattttatgttgcaatcactaattaattatgaagcatagcttcattttttccttgatgtgctatcaacctgctgtttatcatagtctgaatcttatggcaggtaaggtggttatatatatttcaattatatgtaattaatgaatattgtataatttttctactgcctaagatctgcctaaatcaatactattttttaattatcttagtaccaatgctattcaagtgttttatgtcaaaaaagtcattttgatagtttaggcagagtcttaggttttttctttcttgatataatgtgactgctaaggccattaaataatatatgaaagtacattgctatgacaaaatatcaaccaagaatggatataggccacacttatttctttttccattactatagaaatttgatttgtggtaatggcagttaattattttgaacaatgaatccaatcagtctagtcagtttaccaaggaaaaaggaatgtattaaacagtaactttgataatattgggatggactactgaaacagattaagtagactgattcatgctttaatcaaagcaatgttgtgtcctttagtagctgatacatctgttcacacatagaagaatgatgttttgtgagcaaacttaattttcagttcctttaataacaataatttttatattcagcatgttctagttgagttctcacattaggtaatatacgtctgtgagcccttcaatttagaaatatgagttattagtaagaaatatgagttataagtaagagattattaaactaccagaatgcagataaatgaaacccataatgaataatacagattcctatatactcttttcataaacattagaaaagatgaaaagcttaatttagttgaccaatgacccacataaatatattttatggatatttttctggatgtatataggagtcacaaacacatttaatagtattaagcaatcttagtttgaaatcatcagtttcgtttaaatttaaaatgaggactatgaaaacaattatgctttataagcaactgtttatattttcatgagatttaaacaaagcaatttaaatttacaaaaatttaaggcaactaagtatttctttgttataaaagtaaattcagatgtaaaatagcctcaaagcaacttgaatatataaaatcaagaaatccataaacaatcatcattttgaataattgcatttatagccaaacctgctcagtggtaatgtaactaatctagatcacacttatataaaaataaaattgtgtataattttatttttatatataaatatatataattatatctaattttatttttatatattttatttatatatttttaaaaataaaattatatatatttataaatatataattatatataattttatttttgtaggtatagtcctgtgcaatgtcttccttacagataatggttgaaaattagagtataaaagaggtatttttgttactacctagcagttcacttgatgttggtagactataactaaaggataatctgtaacctaatatgatttcaactctattttgactttcaaaagagagaaataaaatagcactatatcatttctaacaagtgtttataaggtagaaattgccttaaattcacatttaaaagaaaccatgcaaaaccttataaaatagcaatatatatatgtacatatatatgatgtagagagaatctattactcttacatggaggcaatttccaataatttgctatatttgtcctgctcttctcagttttatgaagtttttttatggctccagcccaagtattctcagattttaaatgaagagagcattaaattcaccaatttacttagcaaacatttattcaatgggaaatgtactgtgctaggccttgtgagggttgtaaatataaataagggcgatccccatcctcaagaagtttacacagacacaacacaaggtagttaacaaaatgcctttgcagccctcaggaaaataagattagttctgctacagtgtttaaaacttgaaggatgggtagactatcaataaatggaagtggagaataaagtatagaatgaaacagcagatgaagcttggaagacactaagtgtgtttagagaatgaagaggggttaagttaagcaccaaattccccttggaaggctctactgaaaagtgggttatgagacattataataaaaatacacatcggatttggaagatattcaacagtatacttagaagcgtgacattcatgccaagataatgttatcaaatgttgggcatctcttaagatgtatgagacatgattctgcgcttctgaattcatcatcttagctgatcttcacaacaagcctgtaaggagttattaccttcattttataaaaggaaacattaaaccctgaaggtatgcaacgatttcccccaaaattgatgagtgtctgaatcaaaaaacaaaacaacaaaaatctttcttattccagaggactaactcttcactatattttcttttcattttttttattttattttttattattattatatttcaagttttagggtacatgtgcacaatgtgcaggttagttacatatgtatacatgtgacatgctggtgcgctgcacccactaactcgtcatctagcaataggtatatctcccaatgctatccctcctccctccccccaccccacaacagtccccagagtgtgatgttccccttcctgtgtccatgtgttctcattgttcagttcccacctatgagtgagaatatgccgtgtttggtttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacattcgggttggttccaagtccttgctattgtgaatagtgctgcaataaacatacatgtgcatgtgtctttatagcagcatgatttatcgtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatggtgagcattttttcgtgtgttttttggctacatagatgtcttcttttgagaagtgtctgctcatgtccttcgcctactttttgatggggttgtttctttttctcttgtaaatttgtttgagttcattgtagattctggatattagccctttgtcagatgagaaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtgtgaggtttaagtctttaatccatcttgaattgatttttgtataaggtgtaaggaagggatccagtttcagctttctacatatggctagccagttttcccagcaccatttattaaatagggaatcctttccccattacttgtttttctcaggtttgtcaaagataagataattgtagatatgcagcattatttctgagggctctgttctgttccattgatctatatctctgttttggtaccagtaccatgctgttttggttactgtagccttgtagtgtggtttgaagtcaggtagcgtgatgcctccagctttgttcttttggcttaggattgacttagcaatgtgggctcttttttggttgcatatgaacttgaaagtagttttttccaattctgtgaagaaagtcattggtagtttgatggggatggcattgaatctatgaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggaacctaggtattttattttctttgaagcaattgtgaatgggagttcactcatgatttggctgtctgtttgtctgttcttggtgtataagaatgcttgtgatttttgtacactgattttgtatcctgagactttgctgaagttgcttatcagcttaaggagattttgggctcaaagaagtgtgtagagggaaatttatagcacttaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccagaagctggttttttgaaaggatcaatgaaattgttagaccgctagcaagactagtaaagaaaaaaagagagaagaatcaaatagacgcaataaaaaatgataaaggggatatcaccactgatcccacagaaatacaaactaccatcagagaatactacaaacacctctacgcaaataaactagaaaatctagaagaaatggataaattcctcgacatatacactctcccaagactaaaccaggaagaatttgaatctctgaatagaccaataacaggatctgaaattgtggcaataatcaatcgcttaccaaccaaaaagagtccaggaccagatggattcacagctgaattctaccagaggtacaaggaggaactggtaccattccttctgaaactattccaatcaatagaaaaagagggaatcttccctaactcattttatgagaccaacatcatcctgataccaaagctgggcggagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacacaaatcaataaatgtaatccagcatataaatagaaccaaagacaaaaaccacatgattatctcaacagatgcagaaaaggcctttgacaaaattcaacaacacttcatgctaaaaactctcaataaatgaggtattgatgggatgtatctcaaaataataagagctatctatgacatacccacagccaatatcatactgaatgggcaaaaactggaagcattccctttgaaaactggcacaagacagggatgccctctctcaccactcctattcaacatagtgttggaagttctggccaggacaattaggcaggagaaggaaataaagggtattcaattaggaaaagaggaagtcaaattgtccctgttggcagacgacatgattgtatatctagaagaccccattgtctcagcccaaaaactcttcactatatttcattccacttaccatgaatgaggatctgtacaacgttctgagcagcaccatgggacataacaaaactcgtaatttggggacattaatctaacagcagcatgtcacatgatttgaaagccacaagactagaagcaatgacaccgttcatcatggtagaggaattaaaaaacaaaggctgatacttgatgatgggaatgagaatgtaaagaaaactaaaataaaagagataatgaaaaaatatgctgtgatggaatttaggttagtgaataagaaagaggaggaggagaaagaaggaaaaggtggtgcagaaggaagaaaaggtgcagaagaaataggggatagaggagaagagaatgtgagaaagaggggcagaaacatttttttggtgaaaatcccatttggcaaaatgtaaactaacaactaagccacttggatgattttatttactttttatgataactctatgcattagatactattactatctctaatctatcgaatgggaactgaagacttggaaagcctcccttgcccgtggagacagagtctgtagaataggaggctgagatctgtacccacagaattgaattcagcaaaactcatgttcatttggccctccctgtctgtaactgtgagatcagcagggatggttaaccctcttttgaggataaggatcagagaagtattttatttaagggcatagagtaaagttttctgctgtaaaaaatcttcctctattttggggtacagagaggcagcatacatattgattatgcaagcagtaaatctggtaattatctttgaaacgtctttctctttaccttccatttttaatcgatcaccaaacgtcagtgattttatctcttaaattgttctataatccatccaattctctccactttcactgctaccttgctattgcaaacattaacatcttgtatctgggctactgcagttgccttctaaatggtgcctcctacatctgttattttcctgctacagtttgttttgtatactatagccaggatgatgtttttaaaatccaaacctagtcttcacattctgccccctaaaataaaagtaaaatagtaatgtaaaaaaactatcgctttctattgccctttaaaaaaaccaaagtccttcagtgaccaaaagatatttcataggcagcagtgccaacctctgtatcttccctcatttttccatgtagcgctcacactggtgttgcttcatgtgcttggataagctgggactttgttcatgctgttccctttcctaaaacattctctagtcctcatccctacccttccccctttatttgtttaataaacgtttgtccttcagacctcaggtgaaatgtgacttcctcaggagtcttccttgatcctgcaaacagagaaaattcctcttctatagattcttatggctctgtgcttttcctgtggaatccttatccctttcatacatatatattaataagtgtgctttttgttcagtatctgtacctcttgttagtctaaaagcaccatgaggaagatatcacgatttttttgctcttttatgctgagaatttacatccaacatagaacaggtattcagtaaatatttgttgaatgaaccatgaatgattaatagcctcatctgtgcttaaattctagcttctccatttactaaatgcatggacttgggtaattttcgtaagctccacaagcttctctttttccattggatgaagaaggatagtcacaatctaataagtaagattattcatctaaagtttttgacatatagaaagtactgaaataattagctattattcaactacaaaaacttcagggtcacaaagaacaaaactaatgttttttgagggagaaatgtcatttcagtacaaatttaagaaatataaaatacattttaatgttcaggtagtacctgaaaaggataaaacatgtaatttatctgagaagtctaattttattatcataattattaaataattatatatatatatatacacacacacacacatatatataattttttttagatggagtcttgctctgtcacccaggctggagtgcagtggcgctatcttggctcactgcagcctctgcctcccagattcaagcgattctcctgtctcagcctcccgagtagctgggattacagggctcaccaccacgcctggctaattttttgtgtttctagtagagatggggtttcaccatgttggccatgctggtctagaactcctgacctccagtgactacccacctcagcctcccaaagtgctgggattacaggcatgagccaccatgcctggcctaagtaattatttttgaaaattagtatgcattttaccttggtcctcttgtggcccagagtcagatattagttgtttgggaaagtcatagtgaccgataaaagtggaaaatgtggcccagcatactattaaattccctttttcctgtgctgatgcttactgctgtcaggtaaatggagattatgaagagggcacaaacgaatcactagcttctggctcaggaagcagatatagagcaataggcccttcgttatactcagctttagttctgtcacctgtcatcagcatctgtcatttgtttcagaccactaggatatactttctcatccacctgtaccatctccaaaatttccttatgctaccaagttaaaaaataaaactagatgaactgtaaggttcctttccattctgacagtctattattttatccctcatccatctacctcatcaaggagagttggtcaccacaatgctttgaggacatacaatggaaaagtaaataatattattaatagtattgatactaggagcacaaagttaaagtcctaaatatggagaatgagggaaaataataacatgtcatttataagaaaagagttaaaatttagcctgagctttaaagtgctggtcttgaaatctagtgaaccagaaaatttgaatccctccctgttcctgccagtctgttttctcatctgtatgttagtaataataacaggatttacattatatggttgttttggtaaatgggaaagtatctgtcaaatcttttgcactgtgactgggacacagtgatcactggtgaatggtggttagcattgctactgcatgaaatacctgacccatcactatcagccaagtccagagatgctactgatttgcatgtgcagaaaatgctaccaatttctgaattgtatgttcaaagaagactaacaagaaaatagtaaaaaggcagaaagaatacttcctattgctacaaaaggaatgttagttctgtatacaaagtattattttgttgcaaatatacacaaccttttcacgtggggctatggctgctaataaggcttttactctttgtgtaaaaaatgcgtgatttatgcagacagactgtaatatgaaaaccctgcatagtctatttgaatcagcaagtgggcagccacatttatctctgtttactgctgaatagctttcattgttaattccattttctattcctgttgtgcatatcaccccttaatttaaatctttgacaagctaatttaataaaggggatggtttttagagtggaaaaaataaatatctttactcatctttttaaaaattataattagcttaaacaaagaccttaggtatagttcctgtgtttattagccataagagaatatttatgctaaaagattagtttttcttaaatttttaaggtacaactttataaaataattccttcactatttcttcattgttaacatttcattcatataaaggagttgtattttgggtcttggaatgaaaatatccagcttccagagcaaaaaattttcagtcaatcagtatagagaaacagaattttagaagcaataaagtcctagaatgctaaaatgcattgtactacctggtgatattctgttcttgacagtcactaaagacatgttgactattcttatgagatagttctgttctgagtccctgcatcttggttgttctaactgaaaatggcattatctatgaaataggaaaaaaaatctatgaggtatacattagcatgaattctgacgctacagataaatgtaaaaaacatggatagtgtggaaaaatattacagtaaaggagttatgataaggtgcaccaaagtacctaggaataaaaatggaaagaaccaacaattaaataaattagtttcaaatttaaaacatgggtttgcagaagactaatatgaataatactgctataaatcatgatttaaaacatgaatatatatatatgtcactgaataaaatgaaatatatagatatgtttgtgtgtgtgtgtgtgtgtgtgtgtgtgtgtgtattccatttacctgaaagttcagtcacattttattggccacaaatggtcagaagcacagtttcatttgccatattgatggactgttcgttaccaacttagacacttctcagtaccaagccgaataccccaaggagtagcctgggtatcagcagactagataatgaattcttgacacttattcctccagtactgttccaagttcttcatgctgtatccacaggacctaaaacagtgtctgccacactgggctcatgaaataaaaattaataaaggataaaaggaaaaactcctatccaactaacaatttagtatcttaggttaaaaaacaaagcaacttaaaggcaatttttaaaaatttttctcatattaacattctacaaattctattatgcatggcttcagaaaccacagagagccaaatttagctgtgtcagtcacctccaccccagcagcagagtttcccatgtgctaactgccaactgagcctcaactgaagttcatgtattgagtctcaattactgagtcctaacctagttttagacaaatgttccatttcctttcttaggctggtctgctagcctgaaactcagcccacttaactggaacactgacaatctatctaccctttttactagtacccttatacaatgaggttctctccagccaattattgagcatgtggttgaacttgaatcaaccttcttgcaaggacgattttactatcaactatgggtaaaaaacatgccccattccttaagatcatccaaaccgcgagagagagagagagagagagagagagagagagagagaacgagaacacacaggtccagagatgtcattcaggatgtcatctcagacacagaaatttttatttctgaccatgctccttggagaccagcctcacagttgtctcaaaatactgcaaagtcaaacacatgtgattatgacacattaggttctaagatattctcccagaactgcaacactccaacacagtctctagtcatacttttctagcaatgtgagaaacacaggaggcagatgtgagaccagttaattttaaattcataacgaacaaagaattagaataataagaaaaatattatatctaagtttcttcccagtgcagtaaatatattcatatactgaaagaattaatgctgttttcaaagatgccggaattccacatcagcacaaaaagtatggattaagcttctctgtaaccagccttgggctaggaatttgatacaataatccaacaattctatctattacgttaagaagataaggaaaaaaatcatcttctctttctagtaagtataatttgggggatgactggaaacaagtaaaggacaacataagacagaatataatccagtggaaactttagtggtacctgtgtgttataggaacttagaggttgaaaaagtttcatgagagaggtgcaatataagctacacatgcaaaatatgtaaaaatagctcaggcacctgaaacatcagatttgtgaaagatgtcatcatatttcatactgtctatcatgtgtgagtataataggtaataggtaaacagttcgatgtccattgaactataattactccatttgaaatgcttagaggtctattatcaggtgattcacaattacatttgattgattattctgaatttaatgttttctaaaacaatattcaaccacttcttattgtattccagtgtccagagtttctttctatgcctacctagaggtctttacctgaagtttagaacaatcattgttcttattgttatctacttcatgatagatattatgttaccccttcacctattcctagtatgaaaacacctttaaaagaaatatttcattgtgttttcttttcctaaatcctacttgctattcaacacattttgaaggatgaaactgtaatattactactaaaataatgctgttttcaaagatgcctgaattccacatcagcacaaaaactatgtattaagcatttctgtaaccagccctgggttaggaatttgatacagtagtcaaacaactctatctattaagagctcaaagaagtaatagtgagaaagccaagacagaaattttctgtctgattccacattctgtggtctaaatcaccacacttttatgcagaaatatttttaaaactcaatcactgaaaagctattagctgttattattagcagttacacttaaattttgttgcagtaaaactaaaggtaaataaatccttaatttcattgtaactcataaggtatgttaccaaatataaatattatattgacctttatgcaacattgcttgatattaccctatgtactactaatagtcaaacttttaatggagatattttagattacctcttttctttctttcctgacctaataatctatatcttgcaggttattttacacatttatataatatacacagactagtgctattgggggaactatatattaagtaaaggacattcccatatgaaatgtgtataatttcaagataattagcctaactttaaatctagtttatcaaaatcaatcatgttttcatttaaaaatatattgattgtatgtctgtcacagactaaatgtttgtgtccccaaattttatatggcgaaacctcatcagcaatgtggtggtgtctggaggaggggtattggggaggtgattagtgtataaggacagatcccttatgatgggatttatgcttttaaaaaaagaggctccacagagattccttcctccttctgccaaatgagcacacagtgaaaacatggccctctatgagccaggaagcatgctcttaccagacacagaatcatctgctggcaccttaatcttggacttgcctccagaactgtaagaaataaatttctgttgtttatgagccacccagtccatggtgtttttctatagaagcccaaacagaccaagaccatgtcagacattgtactaggtgttggtgtgtgatcgaattaggtgtgatttcttcccttcaggaacttacaaccaaataaaagattcagataagtaagtcaatgattgtctaagttctgtgattaaatgaagcacacagggctatgggagccaaaggacccccatctaaatcacatagtatagtataattaggaaaggctggaggaggagtgactggtccagttgagttttaaagagtaggaattggaaggaaagaaagatgaaggacattcctagtgggaaagcagcaatagtaagaagtacaaaaaaagtcctcaagagacatagttaagaccatgctatgatcttcaccataatcttaacctcagtcaagaccatagaaccacgctatgatcaaagatttaaaatgctatcctgaaatccatgagtcattgcaggaatgctagtggagaatgggtatagatcttacagacacacttcaaacttagatttgcatcactggcagaaatactctttcagatatttttcttaccctttcttattttttacttttaccttctttctatatgggaaaataagttggaaaagcataattgatattgcctctgcagctacatcttcagcatagcatcgttatatattactatcaacatgagcatcatagataacaatacaatgttattttatactaattgggcatactttagcacattgtaaaccataactctagatatcttgacattagtatgtataaggtcttggaaatagctgtaatactgtgataaatgcagtgaacatcaatggggaagtactaaccgtaactgcccgaacctattgagtgtttaattaatgaatgtttgcaatttttgagagacttaatatcaattattttatcaaccaatgggacttaattcaaaaattaaatatgtattcctaaaccaatcattccatgtgaaactgattaagatgtggaaggcccatgaaatatgaaccatttaacatgtgaatacacgtcatgaagatgacattggaaattccaacaaaaatctaaaataagataatggaaattcaaaattaattaatgtgtccatgattaagatataattttaactcagacaatttacattcatatgttatatcttccttagttcctattaagaattaaactcatttagattattgtatttggctgaaaagattctggtaatgccatggtgttcttttgtaagttcataaacaattatcaaatgcttttgttggttcataaacaattatcaaatacttcacatcgtataatcactggaaagagaaaaaagctatcacagatcttagccaattaaagagcttatagtttagtatcaaaaaaaactaggaaaaattaatgtcaaatagaaacatgtaaaataagataatataaataaatgactaagtgtcaaggaaataaagaatataggaaagatatgaattagaattgttcaaggataaatggttccacctacaccttgaagaaaatagtaccaattgttgagcaggaaagagtgaaaatattttaggtgaaatacttatgtatatatgtatttcatatatatatatccacacatacacaatatatgtatgtatttcatatatatattcacacacaaacatgacagaaaagtcatgaagacaataattatcaatgtagttagatgtagttaggggattgaatttaagtggttcacttgaaagaaacagatgaatcattaataataatgaaagatgaattttgagaaatgaatctgagactctgagtatgatttaatgaaaatctttaaagttaaacttttatacaaactttgatgttaaaactaactagaacaccttaaaaagagtgaaataatatacataagaattggagtcactatatataagaagaaagcagtaaatccaaacattagcccaggtttgctttgtggggtttgcttgagggtggtggctttagcaataacaaagaattatatcattagagagtggttccaaggtaaagcaggaagaaaaaatagaatagaagaataaagcctaagaataaaagtctgatgagataaagaaatgtgaggaaggaagacatgctaatacttatgaacgagcagatggaaaagtgtctttaaggaaggaaggcaactagcttagttttctgcgttatacttcgggtgtgcataacgtccaagagctcaaaaacagtgtgaaagactaaaatatctagattcatccactgggagatgatttcaaaacttggagcaagtcagttactctctgcaggatcaaatgctgagaaatgaggaaaaaagattaagtattgaaggttattgttaaaggtcaggagaagaaaagagaaacaaagagggcggaataaaagcaaccagtgatagagaagagattatacaataaagcataatttattctaaaaagaaagtaatttatttttccctttttcctaatctttagaagctgtgaaaagtcagtcatttaaaggtaactttttattgtggtaagaatacttaacatggatctaccttctgaaagttttaagtgtgcaatacagtattgttagctacacacacaaagttgttcagcagattactagaacttaattattttgcataactgaaacttgatacctatttatgtctataacacatttatatactcctgaatttgcgttataactccagaggttaaaaatgaaccacagttgaattgtgtagtgtggataaaatcgatggctctgcataagtggttgagaaatttctgttattctggcacaaacttttggtaattgtaagctatcaaagtctttgccagactgttcagtgatgaaaagtccctgggaataggtaataagagggttgtgttcttaatgtaactaaagtaccaggtgacatctatttgagttactattataattacgcacttttgtatattaggtactctgagacctgaagagtcttgcaagaaaaaaacaaaggcaagaaggcaggaaggacaggatggagggttttttaatattggagggccagaagaaaaggagttatggtttatcaggccccagtccccaaaatggagttgggagcaacggtcattttagaatgatttgactcctctcctttgtatggcttatcctggatgggactcagtaaagacatggaagagaaagaacatcgtgtctcttggagtagatgaaaaggaagatgatgaccacagtgttggcctctctgaggcactgcttgatgcagcctcctccagggtcactgctcatcactccattcctcagtgcctattcctcaggagtgatatcacacagctagctgtcttagtttgcatgtgctgctgtaacaaatacctcagactggttactttataaataatgcaaatatatttctcatggccctggaggttgggaagtccatgatcaaggtgaaaacaaattcagttccaaaggctgctctccgcttccaagatggtgccttgaatgctgtggactcacatggcagaagagaaactaaagggtaaaagtgattagctggttctctccagcccttttacaaagtcattaatcccgtttgtaatgactgagcacttatgacttaatcaccttctaaagacctgccacctcttaatactatcacattgggtcttaggctcatcatatgaattctggggaacacatacatccaaaccatggatatatttataatttacagaagaaaatatcactttcaaaagaaaaagaatttgctccagagtgtataaaccttttattgtcatagaaggaaatacttactttaacaaaatttaagttttacaatattccatactgcatactgttttcattgttagtagactaaaaatttgggccattaacattcaaggtttggacattagacaggtctattatttccagggccatttttttttttattttggttctctttcctttgagcctgggtgggggatatgggaggaactgagaatgagagaagaaaaagaagaggtgaaaagatacaaaagaaaagtttgtggtcatacaaatgatacatttttaaggagctcaaatgttcttgataacattttctattacaagtttaggtagggaaacactggcaaggctctaaacaagcctcagactacagccttatgaatctaagtggataaaaatccagtcttaccatcaaatatattcatggacatttggttaccatttttatatgtaatagcaaaattttctgccaacaagaatcagtgttcagataaaatagtgtttttaaaaatatgtgagaccttcaaaactatggttaaatttgtttttacctataaaaaagctattagcaaatattagacaattgcaagtgttacaaataaacactacatgaaaatactgtaaatatctgtataatcatggaagttagttggaccaaaaaaattgttttaaaaaaaaattaacctgaaaaagttaactatatgccaaaaaggaagatgaatatatccacataatcgattacctcatttttcaagtttattccattctctgcctcagtcccatgttccatggctgtgactccagaaggagtaagcaagaatcagaggaaactgggaggggtggagaccaactctcacaggtcaatgattttaatgtttaccaagcattaaaagcaaagaaacggaggtataatggaacatcccccaaggggagaataaaattagtcctaaaatagtacattacatattggttttggtgaagtgttgcagagaaacaggctgtccttcaagcagtccggttatgttacccatcaggctgacttgtgcacatacggtttaaatcaagaaaggatagttgtcctaatttctttgtgctcataaggggaacaatagttgaaagcagaagttactactacttattgagatccttgaatgtgagatccttgaataacattaagcatggtatcattcaatttatccatcccttttctgctgcctgacagagtcatttctcttctgttatttcctggcaattttaggaaaatatattatggtcacaatatctactagttttaaaaatgtattcaattatttttgcagcgcttctgatagctgtaacactttgctaacctcagacaaattgactacaggattaatgtaatcatttctacagaaagtatttcacagctttaaaatgacagcattctaaaatacgatagtgattccctgacacaggataaagctaactggagaagtttttcgttctgtgtcctttcctctgcttcagaggtcactttgcatttgagttctccttaggctttcatttgaaactgcatgggatcacagtgattatcaggaaatgaaagatccaaccaatgatgaaatgtcatttagcattcttgctgattgtcttcccctcaccaccaacaaaaaaaaaaagtgtctcttatggagacgctgtcaatttatgctcaacatttgaaaacatattggcctaagaaaagggttctcacatttcagtcacaaattttattcacagctagggagttactgaatacagctacttagtctgcagaagaaaaggctgaaaagtaactgagtagttttatgctttttgagacaaccaagacatcaggtcacatcttatcttaacatgctacaacaaaaaggcacaagacaatgtctagaaattaatatgtactttttagtcaacattaaaaggaaattagagaaatattatgcagccttaaaaaggaaagcaatcctgacacattgctgctaatggataaattttgaagacattacgctaactgaaataaaccagtcaaagaaggatacacattttatgatttcacttatataaggtacctagaatagttaaattcatacagacagaaagcagaatgctggtaggcaggagtttagagagagggaggaatgaggatttattgtttaatggtatggagtttcagtttgggaaaatgaaaaaaattggagacggatagtagcaatgattgcacagcaatgtgtatccacttaatacctctgaactgtacacttaaaatggttaaagtagcaacttttgtgttatgtatttggcaacaatttttaaaaaataaaaataagaggaaatgggcaggagatagttagatattggagaattgtgagaggaatggaatcagaacaggaagcaaacatttgcttagccactgctcactctgtaatgtccataattctaagctcaaagctcctcctgtcatccctagccccacagattctggtctcctctttgactgagataggtacagggaagcagtctgagctccactgtggattgcccagacacaaaccaagtgttgcttattttgccttaaaatgctgcaggattgagcttgacattctcctgtcattgcctttttctctttaggtcccattgaagcaaagcaggaagccactcttaaagagacaaagaaatttggagtagcccagtacactcagagtctaatttcttgacctttgtgggaaacaaactagattccatttaattatacagtagtctcattgaaaacagacctcagaatgtgtattactcaagtattgtttgtggaccacatcttgaaaattgcctatctaaactactcacaaaaagaccaaggccattcagagcttttcaaaggaaggtcattaactgtgttccagaattatcttccattttgctgatactcaaatcagagcaaatcatctaattcggtgaagaatagatctagtaccggtatcaggatgatggtctcgatacagaacttctcatctccaaaaatgatgataaaagacgatatgaaggagttgaagtacagggagttttgctataatatttgtttgaaaccatgaattctgttgcaaagtaattgatatactattgaataatttataaatagcataaattttcagtattcttacacataaattcatctggaaaaacattagttgagcacaaaacactcacctccatgaacccagctgaacagacacatgcaacaccccactcccaaaacaaacacacacacacacacacacagacatacacacacatctgagtattaccttggttcaccagtcatcatggtccatccatatctagtgttaacaatgttctgtatgatttcagatcaccctccctctactccttcacattaatgcacatgctgtaatccttccaaagcccacttccacaagcaaatatcaagtcttcttcaagacgaactgccacgtttatgatagtatttatatagtttttaatggtttaatttatgtaaaattatgctactgttttattaagatcctattttttaaatgcgtctatgatgaaaaaattttagtgctacacaccaaccccagttttttcataagccctagggtttctattgtgtaattaagtgtactacagtgatttttaggcatacatatgtattagagaagaagtgattgtattgtgtaagtttgtgtcacagcattactctctattgattcacagtgcaaagaaaatgtgccttctttatctctaatggcccatagtatattttttttcatgaggtctccacttgcaaggtagcatataagattttactctcatgaagtatctcttattttataaagaaatggccttctaggccctctcctcaagaatctcaaacagaaactgggaaaactgtaattttgtctttggctttgttctagtcattggacctaatgtgtatagatctcactatctatccagtgcttccatccctgtctcctttccatatcccttgggcctaaaagtatatgactttcattcctgtgtttttttagcctggacttctcttacatattattccccttccaaggacagctagcatcatggttcagccagattgatgcaagcaataggcactccaggctatggaagaacctatgattgagttgcagggtatctcttgatattaactaggataaagaattggaggaaattctttcatctctcaacaaagcctggctttaaagattatgttttaccttcagtctcaaaaatcctacactggatatcaaaatttaaaagttgattgtttctttttgcattcctgcaataacaatttgaattctctccaaagacagaagatgcctgtcacaggatggggaaaatcacttgagaggaaatgtaaaaaatagcaaaaacaatcaatgttttccaacagatattagctctatcacatatactatatgaccctcttctctttgagttggcataggtactacattttatatgatacttaaaaatataaacattgaaaaacataaaactgaaattttagtaatgtttaaagcatattgagaaaaatctcaccttcctgaaattctcagattcatgtcagaaaattttgcttgtgtaattttctaccctagaaagagcatagccatttcttcatcacatcaaacccaagtacagtatttggtaaagaggaaataagagaatcagtcatggtccatgaagagaagtcctgtgacctttctagtgtattggactataccaccaaactttactcttgaaatacatattttctcgtaacttgtgagtagaaaaataaatatttatttcataataagaaattacatacaaatgttccactattcccctaagatagttcaacatgaaactagccccatgcataaagttgaagaaatatggaagaaatttgttggagtagacttaaatttcaaatacttaataataaagtcatttaaaataattaatacaatttacttaataaccaaatattatgctactatttaagatgcttactgtctaagttttttatgtagataatgtaaggaaagttactttatgtaaattaatattcaatttattaaagttatacattcaagtcttttcttaggttaggttcaattaattgcaaattaatgatcacatatttatctggaagagtaggaataataagcattgtactctgtaacaaaattaatacaaaagattattttatctgagcataaaaaaagtctgcaagagataaattttcagtgaaaatataccatatgtccagttaaaattagactgtgaagaataagttgaagaatccaatatttctttaaaattgttaggagtatgtttaaacagaaggcatgattgttttctcttttaatgcttttctgaattttgatacccttactctgcagcatccagcagaatgttttatgtaaaaaaaaaatggtgctaataagtgtgtgtggagaaaatgaataaaaatatttttattggaaaaaatatttagattcatcttacatgattttttaaaaccaatttatacattaggtaattgttttgaaataagagcaatacaatgtctcctttgactaacgttcaaattaattttaagagattgaatttctctatatagttaatctcatttacagagagttaattatattatcttaaacacttatgacattaaatatgtaactttagtacatctgattatctcaccattttaaatgtcggaaagtgcagacaagcctagcatacagtcttcctaagaacataagcagttcttgtaaagatttctaaattttatttattacttcagataactcaaataaactaaagcgattacactatatatttttaagttgaacagaaaaataataatagtgacttgacttaatttattatctctctaattatttgttaattttttcaaggttttacacatacttaggaaaagagttactattttagacagaatctaaatcatgtgatagacatttgtcacttaatcacatatttgagccacaccccccaaaaaaataacctgggaccttacattctttcggattcaaaccaagttacaagtaaataccctgaaactttttgtagttggtttctatctgcttgttcaaaaacagaagccaaatccatatatttctgttgggaattagttttgtaagttggtgaatcacttgtctcctttgtcaagtgtcatcttaatactttttaaactgcttttagctgtttgggtaggaaggtagaattcttaggttgcaggtatattccagcaccacttgaattaatttatttaatcttactaactgaaaggattcttcattcttttcatattattttctcttttgactcttggccatgattcaacagagagtatatgaatacaagcatatatttgaaggtaggaatggtaggtctgtagtggaatgttaagcacaattgacctaattgtcaaataaaatgtgcagctttcagttgacatggtatgagcttgaatgatatttggataatatggatgaaagatggataagataggagagtagcagctcagatgaaaaatgggaagatctaattcaagcctggctcttgtatttaatctttggaagatctctcaaggacaagatgatctattgtaatcctgccccattttcctaattctgaaattctttgagttacttaaaaaacaaaggaagctatatattgtcttgaaagtttttgaagccagtaactactattgcaaaagatgaagctaacagtaaaacatctctttcttatgttatcatgctacctgaatgattcactttaaatagatttactttgtatcttaacttcaaactatgctaatatttaatccttgaccagaaccttggaatcttatattggttgaatgcaaatatttactaattagatttatgtacccataatcaacattttctaaatacttttaccaacacatgatgttactatttaacctaatgattatattttgatgtaggttttgatccaatgaaaaatatcaacgagccggcatttccccatcttctcttgttttgtttatgtcctttgtctcttttctactttccttggcaactaaagttcccctaacaccttcttatctgcaattaacttgatcatatttgtttttgctactttctgaaaagagaattttctgtaatggcagcagcactactctgagaattgaattccacattaagttaacctctctgttgtcaaaaaattaaagtactaaagtgtttaaaaaaaacttacatcacaaatgttcaaaaaatgcagattgaaatccagacacaggaatcctttgatgatagataattggaattactgtaaaaaaataagtattattacctttttccaatggttctcagcctaaacactgttattgttgaaaccttttcactttttatccacattattctaatagtgtctgaactgatctctctgcctgatatatttgcttgtaccaattttttttatagacttctggccatatggctttgccttaaatgcaattctgcacctattacactccttttgagtctagtattcatttgtttcacaagtcacttgggagcacctactacatgctgagaatctggcattttctcttaggagaagtcaccaataaatacaatattccacatactatgaaagaggtaaacctaaacatcatagacaagggttcctcgccaagaagtcaggaacaagtgtcccctagaagtgatagcaaaactcagttgaatgagtcagacaaaaatccacaggacataaattagtaagagaaagaatgtagcattgggagagggaaggatctatgtgaagcaggttcactgtgcactggttaccaatttgtctgagtctagggagacaacacatttataagcaacaggcagatgtatcacttacagataggcagcaagaaacaacagaagcccaagatttattgtgagctgaattcaattctgtgaacagaagtccaacattcattgtaagtcagaaagctgcccagggaagatgagctctgggctgctcatggccccacttgaaccacagatgtggaaccctgagaggcagctcatcctggcttatataccttggggtcacataaatcactgagctaaattattgaagggcattctgctctgggagaagcctggaacagaacctagctgctccagccagttagctttatctcaggatgctgcactctcagcacactctgtgattattcttaagaattacacataagaaaggggaaagaactgggtcactccagagccagccagaaaactgtcctgcaatctgtagtacagtaaaagccttgttactttacataatcaggaccagtttctgattaaagagttaaagagaagaattatttcttttacaaaaagatacatcagtcttgtattggatacagattaggcaacaaaacaaaatacagcggtttttaacaagatagaaactacctttacacattagtctgaacgcaacctatctaagaatgatgtggtaacttttgtaaagacccaggtgctttctataaagctgttgtttttaccccttgtgtgatggcctctggctcctggttgaagatgatcaatcagccattccagagggagtgttgtccacctgctctcatgccccctaccatggtttgaatatttgcccccttctgaactcatgttgaaatgtaatcctcaatttgccagtactgagagatgggcatttaagaggaaataagattatgaggtttgtgctcttatgaatggactaatttattcgtagattaatgaattaataggttagtgaattaatgggttattatggaagtgggactgatggctgtatgagaagaggaagggagacctgacctagcatgctcagcccccttaccatgtgatggcctgtaccacctcaagactgtgcatagggtccccactagcaagaaggcccccaccagatgtggccccttgaccttggacttctcagcctccataactgtaagaaataaattatttttcttcatactttacctagtttcatgtattctattataagcaacagaaaatgaactaagactccctctttttcttccctgcatttatcttgctgatgtggggaggataggaaagaaagtgactatagtcactgtctttgtacatacctgctcttgagaaactgttagtcctttatcggccatatcactgtgcttttcacctatttcctgtgaccatgataagtatgagtgatggctttagcaggctcccttgacaagttggtcagcctctggagacactggggctttagtctgacacccagttggtaaacatccctcaaaaatgctctggtttatgctttttttttagactgagtctcattctatcacccaggctagggtgcagtggcatgatcttggctcactgcaacctccgcctcccaggttcaagcagttctcctgcctcagcctcccaagtagctgggattatatgcatgtaccaccatgcctggctaatttttgcatttttagtagagacggggtttcaccatgttggccaggctggtcttgaactcctgaccataggtgatccacccaccttgacctcccaaagtgctgggattacaggcgtgaaccaccacgcctggcctggtttatgcatttttttgtccccaagatgatatggtttggatttgtgtgtctgcccaaatctcatgtcaaattgtaatacccattattggaggtggggactggtgggaggtgactggatcatgggggtggatttctccctttggtgctgttctcatgacagagttcttacaagatatgatgaagtatgtagcacctccccacaaccttcctcctgcctggccatatgaaatcctgactgccccctttgccctgtgccaagattgaaagtttcctgaggcctcccaagaagcacatgccagtatcatgcttcctgtacagcctgtggaaccatgagccaattaaatctcttttcttcataaattacccagtctcaggtagttgtttatagcaatgtgagaacagactaatatagaaaattggtactgagaagtggggcattgctataaagatatctgaacatgtggaagcagctttggaacaggcagaggtcggaacagattggagggctcaacagaagacaggaagatgagggaaggtttggaatttcctagagacttgtcatatcactatcagaaatgctgatagtgatatggacgatgaagtccaggctaaggaggtctcagatggagatgaggagcttattgggaagtggagcaaaggtcactcttgttatgtattagcaaagaatctggcagcattgtgctcctgctctagggatctgcggaactttgaacttgagagtgatgacttaggttatctggcagaagaaaattctaagccacaaagcattcacagtgacctggctgcttctaaccacctatgcttgtatgtgtgagcaaagaagttacctgaaactggaacttatatttaaaagggaagcagagcataaaatttgaaaaatttgcaacctggatatatggtagaaaagaaaagcccattttcagtggaggaattcaagcaggctgcagaaatttgcataactaaaaggaaggcaagtgctgatagccaagacaatgggaaaaaggcctcaaagccatttcagagagctttgcagcagttcctcccactagggaggaggtaaacatgatttcaaagtacaggcccagggcccagttcccctgtgcagcctgggaacactgctccctgcttcccagctgctccatctccagcagtagctgaaagggtcccaggtacagcttgggccactgcttcaaagggtgaaaaccataagctttggcagtttacatgtgataataagcctgcaggtacatggaatataaaagttgaaacttgggagcctctgcctagatttcaacggatgtatggaaaagcctggatgtccaggcagaatactgctgcagggctggagccctcatggagaacctctactaggacagtgtaaaggggcaataagtccccactaaagcactgcttagtggagctgtgagatgaaggccactgccctccagcccccagaatggtagatccactggcagcttgcattgtgtgcctggaaaacccatgggcactcagttccagcccctgagagcagccatgacaacaggggcaaaactgtccaaagccttggaaatccaccccttgcatcagtgtaccctgaatgtgggacatggagtcaaaggagattattttggagttttaagattaatgaattccctgctggctttcagaattgcagggggcctgtggcttctttcttttggccaatttctcccttttggaatggcaatgtttacccaactcttgtaactccattgtactttgaaagtatctaacttgatctttattttacaggctcataggcagaagggacttgccttgtctcagataagactttggaccttggacttttgagttaatgctagaatgggttaagactttgggagactgttgggaaggtatgattatattttgcaatgtgaggttgtgagatttgggaggggcctaggcagaatgataagatttgagtttgtgtccctgcccaaatctcatgtcgaaatgtaattcccagtgttagagatggggcctggtgggcagtgcctggatcatggggatggcagatttccccctttggtgctattctcataataaaagttctcatgagatctgattgtttaaaagtgtatggcacctcttccccaccctttctcctattccagccaggtgaagtgctggctccccatttgccttctgccatgattgaaagtttcttgaggcctccccagaagcatgctagcatcatgccccctgtacagccaattaaaccgcttttccttataaattaccaaatgtgaggtaatgtctttataacaatgtgagaatatctcatagtggttttgatttgcatttctctgatggctagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtcaattttgccttttgttgccattgcttttggtgttttggacatgaagtccttgcccacaatgtgcacatgtaccctaaaacttaaagtataataataaaaaaaaaaaatgtgagaatagactaatataccaggttgaacaatttttggcaagtctattgctaccaattacaattttccttcatagataactcatgctggttgtaggtgggcccaggaggaatctgtcctctatacctctctggaattattaattcatactggtgattcttgtccctctctacttagacattccactttgccctctcctcagtttcctttcacttctccaggtagcatcagataagctgcaagattaagtataaatgcaatggtggaactgactatcagtctttctttcatgttgaaatcctcatacttgaagagtgtttttctaaggatcctgcccttggcaggatgttcaccagttgggtaccattctctcctttttcagtgtagagatgaaaggagaggacagttcacaactattgcatgctctcaaaaggcaacttttcacatccaatacctcctcttttactgaatggggacagagagatgaggaggaatgattactgatagatgccaccatgcggtaggtcttgtggggaggtagatggcaataagaagaagaagaacagtaaccattgagtacttatatgccaggttctcttctaagtgttttacacatattaattcatttaattcctccccaaaccactatgaggtggtacaaatttctttttggtagatgtgcttgggtaacttgcccaagtttgcagtcttacaagaagtggagctagaatttgatccaaggcactccagttttaatgcctgtttccatgagcagctatagttatactgatgcttaggtgctatggagcattgagggtcaactgtcaagatgactcaggaagagggcagatatgcaatttgaagtagctgttgaaacatggcaaacacaacatagtatgatgctagagagtggatagatgagaaaataatgctggtgtggcccatcagataaagaagcagtcacatctcctaaaaacagatgctatgtctcacaaaccaaatagcagtctttttgtatatacatggtaggaaaattgttgttaacccgatatcagtgttgtctgccacaaatacacacatgaataacaagctgtcaacagaagcaccttctcaaggcatcaaataaaatgatgtgtagcagttactttaaatctccgtagtcccttttgttcatatttgctgtatcactgtacccacatattcaacaaactctataaccataaataaactggacttcagttcagtcctgtgacatcacataaaatgtttgaattctagacagaattggcaaattgttgtttttacagaatgaatagaatttgcaacatgatcatattagtatgcgtgtgagtgctgtgtctgtataaaagtgccttgttaagtgataagaaatcatctgccaatgttgtttcttaatatttaatcatatatatattaaatatttatacaaaggtgataatagaattatgtggccacagtagaaatacaagagaattctaattctacaatattgtgcctaaaattgtaatccacttaatcatccttcattgcaaatgttttgtaacttgacagctattattaaaaaaggcaaaatgtggcatattgtaaaaaaaaaaaaaatcctcttaccaagtgttcttgacatttgacaatgccattaagctaaaagtatcaaagacagagttttaaatcatgtgaagctgtggttaagctgatcttttccaaaaaggtttacagaaaatgtgttttaacttattgccatgaacaaatggaggcaacctacatttttttgaatttttgagattagtaatatatccataaagtagcagggtcatacattgtctgtaccaatataccatggattatattacccctatggcacctatttctcatcccccccaaaaaaaccaataagattatttgaaatatagagtgataaaatgtttcagacaattttccagatgccgaatttctaagcaaagaaaacaagacacaaagtaaagcaaataacagaggcttgaggtaagcagatataaatttcttcatagatggccatccaaatgaacagaaagagattgtaggatcagtgcaccaaactaccaagacaacttcagtaaatagtttagaacacatagcagcccccactccgtggctaatgataatgaaatcctagtcacaagctgctcctacaattgaaaaatgttgattttgctagctttgaattgtcatctctttaagaataaatattgatgacttagtgccattttaggtagatattttaagaacccactagtaacacacacacctatcttcccaacagccgggctgttaacataataatttatacaacgtcacctgctgatcctggagccccactctgaggagagaagttatgcataattaattatattcatattttaatattcatattgctgattatgattgtcatgatttattatccaaacttcatatgtgaggcaaaagcattataaaagatatgttgtaaaaggtgtttttttttttattagcagaactaattgatttgtagatgaacacttttctttacataatggaagcatattttgattactctgtgaataaaaccacaattactcttctcattttaaaaaggtacaaaattatttgtcttttttgccaatttcttacttgatttagagaccgtgaatgtgaacacaccatttttatttaaaattccctgtcatgctatagcttgcctctctcttaaacagtgataacatgtgtattgacatactaacaagaagaatttgaattaaggaggaaaagaccatctgaaaagaattccatatttctccatgtagaaataaggaactaatctgttatttcttaatatgaataaaatttagagatatttttgataacctatgaatattagattatctgctgttaattaaactcaggcctgatatgatgcctgaaacatcatatgcagcagaagatgccattacaaaatgaaagtacatcatctgtatctactggagtttccttgagatttagcttcaaaaggtaaaaactagttccgatttcacagagaaaataataatggagaccaatttatatacaagtacagtttttcctgttgcaacatttcggtacagacattcattcaaattcttgggaaaaaactgccgatgtgcagtttgtatatctcttatattcatacatggaggagatgatttatatgctagtcaatatttaagctgaatttggggaattctattttagctatgcaggggcggcgaatatgatgtactaacacttccatttaaaagaacttgtgagcactgaatttgtaatctaaatgttagtagaattaaaaagagggatggaggtggaactgggctacctgccatgtaatatagtgtggctagtacatatatttggttagccaaaacaaattaaactcagaaaggaggtaaaagatgctttattgcaatagtcatattcaatctgaaagtcaacataaaagtgtcttagcgtgaatggttattttctttctttaatgaatgtatatggtaggctggaagtcattaagctttaaaaatttagagaatatttctatatggcaaagtaaaaaacctattaattaatctgagtttctggcatgctttgttccattaagtatagacttataggaaaaagcaaaatataggagaaaaaacaacagagagaaaaactagaggttaattgcctttgttgatttccaagtagttttgacagctctgatccattaaaatatgtgtaaaaattgatgaatgtattcttagtaagactgtgttttgagaaggtttttctcaacactgaggttttattccattcgtaatccaaataaaagctgactaaattaaattaatagaaatgtcagcttctgtaagtgtgcattcttatgctaaaaatattgggtaattttctcatagctttccaatggagtttgcacattcacatcagagtttatttggtggaaaggagtaatacctgattagtactttttctttttcttactattttccttctttgggtaggtaaataaaaaccttagagtaattgcatgagttatctattgctgcataacaagttatcccaaaatatcatagcccaaaacaacaaacatttattatttcactatttctgtgggtcaggaacctgagagtagtttacctgaaaggttttgggttagagtctctcctaaggctgccaccaagttgttggttggggctacagtcatgtaaaggtttaggtggaggaggattattctaagttcacctatgtggttgctggtgggccctggttcttcaccacgtggccttcccacagggtgcctgatgacatgacagccagctccctcagatagggggagaaaatgaagggtaaacacaagtgcacccaagatgaaagacaccatctttttatgacctaatctaggaagtgacatcccattttctgtcacattcaattcattagaagagaatcactaagtccaacccacacttaagtggaggtagttaagttctacttcttgaaggaaggctattgtattaattttctattgctgttgcaacaaattaccacaagtttagtaactttaaagactcaaatttagtatcttaaagttctgtagatcagaagtccaacataaaggtattagtagggctatattcctttctggaggctccagggaagaattcattttcttgtcttttccaacttctggcagcctcctgtattcctttccttgtggccccttgttccatattcaaagccaacaatggtgggttgagtctcatatcatggcactatgacctcctcttcttccctcctcttccaaacgtaaagacacttctgattacatgtgaatgtacccagattatccaggtaaatctccctattttaaagtcaatttaatttccctttactttgtaatgtaacatatttacaggttccaggaattggaatgttcacatctttgggggactgttattctttctactacagttgtcaaataatttgtggatatattttttaaacctctacagtaataatgtacctagaatcatcctcctgcccaaatacacacactcaaggtccagtcctttcagaatatttattaaagtctagtggatcactaacccaggtaacaaactgcctgcactagttattcagtatccaaaagagatcaacatccatacctttctctttctcaggtatctatggttgcccagattaagtaagataaaatttttaccttaaagtaggagaaagtaactgggtttagtttaagaaatatatacatctggtgtcagaaagaatttgttataatctgagttttgctagaatactgccatgtggtcttatgcaggttactcatctcttttgcctaaggttttcttacttataaaatgagggaaataatattgatgttgcacagatattgtacagattcatttataattcagaaattgattatttcatcttctctgttgtccaaaatctactgttttataaaatgactgctattgatactgttacgtatctgtgatgtgatctttttcttctaaatcttgaggttactgataaacaatatctttttaaaaacatagtctagacctccaccagtgatttatatgtctcagccctttcaggcaggtacccagcataaacatcaagactcctttttgaggaatcacatgttgccccatttgcctatcttataggccattgctagacatagtaattatgccaaaacccttttaatatttattcataaacaagccccaagctaatttatccatgtacccttagatattatttttcaaactgaaacttctcattgttactaactataaaattaaaaattataaaattgattgttatttgtgaatgacactgtaaatttagtttaaaattcaacattgaagataaaattagattttttttccatgttgatatgaatacaaatttgggtggaacagagcatggtggtaaaaataatgttcttactaaattaggagacctatagaacaaaaatgtacttgaagttggttatgttatacaaataatttattgttgcatccaaagagctgtgatattctaccaattcatacaagcagagatataagtatcacattttataaatattttatgtatatacagtcatgaaacagaaatacaaaaatttttgtgataatctgatattgagacgaaaagaaaatatcagcgtatttccacagaatctatctctttactacctatcacagttggattttaaaaatgtttacatttaccacataaattatttacattttgtttacattttattagaaattagttggaaatctctaatcaaaatgttaagcaaaattcagatttttaagtttgtaaagaatttcagttattaaaagtaaatctcatgaatgaaaagacaaatttattctcataaaagcaaagaagggagtaaataaacattgagagatctgaaggaatacaagatttaatttgaatgccaattattaggctctgaaatatctcaatttgaaggaaaaggttttaatggagcttctatttataattagatagttatcttctgtatcagaatagaatgaaattgagaatgcctgtaactgcatgatatctacatttgctgagacattcagaagaaaattaaaacatttttgacagttttaatcatagaaaatatgttaaaagcactctgtgaatggaggtaaaaagaccacacttataaaaatattggggctaaaatatgtacacatttcactacaaaaatagaatagggaatctcttccatttatcataattggctctcagcttattttcctcagcacctgtgagaggaagtattttctcaattaaaaatgtaatacttacaaagcaaagtcattggaaaagagtcaacaatgtcaaaactattaatgaaaaaatgcaactttaaagacctttaaaattgtatgaaaaattagaaataatacagaaaaattaattttcagaaaaatataactgaccaggatatgatacataagtcaaaaaaactaagcaaagtgtctggaaaatcattcagttcatttatatttaatattcagagagtcaacctaaatttgttttaattacactttaaatatgtttattaaaagaatttatggaacctatagaaccagtgataattacattatccaatgaattaattaaaattttgaaattatataattttaataattttaatgccccctttaactgtaaagtgaccacatagatactaaattgcaagatcatcctaactagaaccttgttcatgaccactttttaccttccacagcaatgttgagtcacagaagctcagataatacactcattaattcattgattaactcattcccatatttaacaaacacttattaagctccatctatgagtcaaatattgttctaggttcattgaatatatttttgagcaaaacaggcaaacatgggagggggtccagtaatatacaacatacataataaattttaaaatagcattgtgtattaggagttataaatcctttggaaaacatacattcaagaacggtaagggggcttatgagtgtgaggagtggtagggagatgacaatttgcaatattaaataggtgagaaggtgacacttgagcaaagatttggaggaatttagggagttagccgtgcattatctatggagagagcaggccaggggagacgaaactgctacagggaagggcaacaaagcaccaggcatgtttgagaggcagcaaggagaccagaatagctaaagaggaataaaggggcagtagcaggatatgagacatgaagggcaagagagggaatgcagtgggatagaaagaggagagatacagatggcgcacttcaaaaatcctctaaacactcttgtttacacaacagctagaagaatttttatctcattggatgttttgtgttcttacttttatattagcttggctttgttattaaatatcatatatcccatttctctcctgtctttggtgaaggatcttagatcttttgtatttccttgatgccttgctctttcaggtttgtattctcagtcaaaagagctctttgaagttttgcttccttatagaattcttaagaatcacatttaatttaatggctttttactttacatatgctcatagacactttatgaaaagaatctttttgaaaataaaatcactaaatatttggtaatttcccaacaaattatataggccttgccataagcaatggattttttaagttaaaaagtcagctttatccacagaatatgatgtttggagtgacagctgaactcagggtcctggcatcactaattattagctgcattaccttgtgcaaataagactttctgaacttcaatatctataactgggaatcaataataagacccacaccacaagatcattgtcagatttttctaaatgtgtgtgaaaatttgatcaactatgaaatgacatacaaatgttaccaaccattattatcatcagtgcattaatatagcattattccattctgagctttagaatggaataattagaaaagcatttttcaaatgtctttcctgaaagctttattcttctgctcagaattcctagtattctcttttcaaaacatcttaaaacaataaaatatttaaagatataattgaaggaaaagatttaagctaaatgtgttatattctagggttgtatacttctctccacatgaaacacatttagtttcctaacattagctctggcatttcattatatttatgaattataaaatacctcacatagcagcctcggttttttaaatgtggaatacaaagtcatcacaaaaaggacctaagaaaattaagtccatatatacgcgtatgaaaagagagaaatgagaaaagtgaaggaacaagaaaagaaataccaaaatcttggggtctcctttgcttcaccaaggtaaaacctgagagttctcaaggaaactgatgatcccgactttctgttggttgaatgttaccaacaggatattctttaaggaatgttttgtcctcaagtatgaaactaaataaactcttgggatgcaatgaaattaatagtgctaagtctgttcactaatgatgaatatatagctgagatttttcaccatgtgatttttagtcttgattttcttaacagttgtattcaccgttgatgtcaataatcactgagcatatttgtcaaattgttaagcaaagttctaaacatattcaggaggctactggtgaacacttgtctggattttcttctattcattgggtttctataggctttatctcttgataaaatatacctccttcatttttaacttttgtagagagaaagatgttcatggaatatagaaaatattttttcagaaaacttattcaagataacagaggacacaaaataactttttttaaaatccaaattataagctttaggaattaagtaaatacaaacttgttaattaacggcattatcatttcgtgtttgctttgtatcctatatgaaacgtgcttctgttctcagctaaaatttttagactagacatagatgaagcatgcaccaaagccacaaggattcgtcaactttcatggccacttatgcttcaaggcaaatcaaaggtgttttgacaattagctaatagaacaaacaaacaaaagaacagagacagatctctatgactcaactgatagagctgaggcatttgccgagtttcctggtagatgtggttcgataaaacgtctaacgttagaatctgtgtcttgggaagaaaccacctcatataccaagaacgaaccctgagggtggtctcactgatagttctcagtgtactgccatgttcccaaagtgtgaaggctacatctttattatgatgcctgttacattttctatagttagcggcaggtttgcttttctctgtgatatccttgagcatacaaaaatgttcatgtttgtttacccaaactttagcatggcaccgggcatatgttgtatgttcaaataattatttgatcaatgaaaatgaatgctccctgacattttaattttattcctaatataacctttgaatgaaatatataataaatatagaaaggcatccaaatatatatgtgctttttttcacttcagtttctattagggaaaaaacagtctaaatctaaataagtcacatacaatgatcaagcttaccaaataactagtaagaagttcaagtttccactttgatttgcccttgcagacacagcctgggagcatggagaattttctggtaacaaatgggaatctggccaaccaatgatctctacattagcattctaataaccagaggccaacgtgccatagtgctgtgtcagaactaatttatgaaactaggtccaaaggctcattaaaatggtcacaattcagtgactgcccagtaaaattagactacagtttcattcttataacaccgaatattttaacatactattaaggacatacttcaagtgttaaaactagctttgatgctgtgaagggaaaaacaacaacattagaaagctatttacttttgtagaagattggctccaatctcagattttcgctcaaaatgctacaaatgtccatattttagagccctgggtgtgctgtacttgcttttgcaactctggtacatttgtgggtttttttgttttgttttgtttcctcagagtaaaagcactgctgtgtagctcttgtaaaccacagggctgtgaacccacctggccaggaaattgcaggcagcacagttgggagttgaattttcttctcctctgctgccagacagatctctctacagcactcctttaatcatgcatcctcccctgtgatgccagagctcctgggacacagagtgcattgctttacaggctgctttccacagccaaactgggtttgagtggcatagaaggtgtgacattcaaaatcttatgaagaacaaggagaggtagtggggaaagttctagattaggagtctggtgcagctgcagttcaatctgctgctaactctcagacagtcctgtctgctgctggggcagggtatcacctcttttgctggttcaatgcttggcacgtgggctttgctcaataggaaaggtggttatagtgaactgaactaacagtacaaataagaaagccatttaatttctcagtatctcaaacatctatatatacgaagtgggaagaatggctcctgctgtgcttatttcacagggttgttctgaggatctcaactaataataactaccaaaacactttttggtggtatggtgcttatacttgggtaatgtatggttatgtccgttcacttgtcaaacataacagactgttttctttatctcctgaatttttattcaatggaacagtaatgaatccctaaatcttctaaatgtgaacagtaaaagagacagaatgacttttcctggcagtctgcatgccatgactgaattatttagacttctatttaaacctgatgaggaaaaaaaaaaaaccctaagaataaagatttgtcttttaaccaattatttcagaaaaatgtttcttttagacttattcacatttagaagatactattgatagtgtggatgtcctattataaattagataccatttccatatcaaagttaaatatatctgaaaaatgacagagccagcagggattgctagtggtagagtaagttgcaaatgtcagtttattgtagcagtgtaaattatatttaatttaaaagactacgtttaacttttaaaatgagggtactccaagttgaatccatggcaaataaataaatataaaatattttcctaaacatgtcagggtatctcataaagcagtatcctagaggagctctgatttgctggatgctaatagatatatcgtccaaaatatcctaaattcatgtatatgtaagaacatttgagttaaatgcaagtgaatctttttttgcagttttatctgttaagtgtaaatagccaagaaaaggatataatgtagcatttttactaacagttttactgtgataaatttgtttcacgatacctaataacatctcccagccaggcgtggtggctcacacctgtaatcctagcactttgggaggccaaggtgggtggatcacgagttcaggagatcaagaccatcctggctaacacggtgaaaccccatctctactaaaataaataaataaataaataaataaataaataaataaataaaattagccaggcatggtggcacacgcctgtaatcccagctacttgggaggctgtggcaggagaatagcttgaacccgagaggcagaggttgcagtgagctgagatcgcgccactgcactccagcctggcgacagagtgagactgtctcaaaaaaaaaaaaaaaaaaaaaaaaaaaactcccaaaacattgttctgataaacaccattttataaaatgtgttggcaacatgtgtttggttagacttactggagcccaaagttatgccttttggtctgtataaatttaattaacaatagacttattgagcatctattgcataaacaacagtgcgtggggtgctgaagggcataagaaactgagtgaaattatgactgccctttagaagtccaaagtcaaagggcacccatactcagtgtcatggaaatggtataataaagtaggtgcgaggtgggagagtcacatctatttgggtgcagaattgaaagtatcttcccaagagtcaaaagcatgaaataatagaaatccattgtgatcacctttaatagtatgcttacaaagattggtcaaataaatgtagttacatggctggttagtattctggtggatgacactttggaatagcacccgtctccatttgcttcatctcatttgcctcaagttagaataggttcagctcattgacttttttcagttccataagtttatagttatatctgtcacggcatcatggtattgcttattcagttttaaattaaagaagaaacaaaaattggctaaatttttgagagcagttaatacatttttaattaacttactgtgaaaagatacagttagtagcccaacaggatatttttcaattgtttgaacctgaggtttaatatcagagggataattttggagcaaattttactttttttatacttttttcatgctaacttgaaatattgaaacttcagaatgagatgggtctattctctgcttagagagaatcatgacaaaatgcaaatggcccttctcccttcaagtgggggcgtgccaggcatcaattagccacaggtagagttctcttaacctgtggtttgttctcttctgctttatccctatggctggaatggagtgagagtagctagcttctccacgcagatgtgatgtgtagtgcacccaaacataaataagtcttatcaaaagaattcatttaaatggtgcctgtttggttttatcaatcctcactcagaagaacataattctaatagccagataacaacgtggaccagcctggtatataggcatctgtaaaggtacttctgcacaatgactacaaatttaactaggctttttgaaatatgccaaaagcatttattgggagtgattaaacccacatcatttcttgagaacagtttaagagctctgaacgttgatattttgtataaatctctttgtaaatccagaaaacaaagaaataacaccttactttttgtgtctcatgttttactacaaagcccctagcttatgagagcgtagaaaattgaaccttggtcattcttccatttactctactttgtgagtaacttacacagtgccaggataatcagggaacaaaacctcaggagacttctctgttgttggtgaccacagagttactgctaggatgccatactgtgtgtctggtcccttcaaggccaacagctcttgaggcatgagaacctaagccttggcttccaatgaagctggattgtcctgaatacccaattaatcttgtatttataaagttcaatacaaagggactgctcgttcattcgaatcttggcaaagcttatgttcactatgattacctgagctctttgcccactgtaccctcctccatggaatcctttctgcccctttcacccttctccctgtctactaaaaccaggttttagatgataaacaacatagcactgcagaatatgtaaatatgcatacagatatccttcacttaggatggggctgcatcccaaaaagcccagggtaagttcaaaacgctataaattgaaagtgtgtggctgactaggagctatggctcacttccactgcccagcaaagcgagagaagtatagtttctacagaatgcaaattgctttcctaccattaaaaactcaaaaatcgttaagtcgaactgtcataactcggcgaccatctgtatttaagcataaatttccatacatccaaaagaaaattctgcatttgaacacgtttcattgtatataagtggcaaagtattttctttggcattttttaatacctttgaaaggaggttaatgtgtggaaatactgagtttaacaacatttcatgaaaggtttttcattgtatgaatatgctgtcaatctaagtgtgttttcagaatcactgacagtatattatttttaagaacaagataaatgctacaatattttgtcaataaacttaagtctcaagctttttatttattgatgagaataattttacatgttcattttatgtcattaagtctaagctagaaatatataaaagatgtctgatgatattttcatgcgcatgtgccctctaccatcattacagagcttaaaaaacttgtagaaatctgtttttattttacatgctttttttgttacaactgtgtcacatctaaaagattcagacagcctcgatctggctgtgccttattctaagtcatacaagagtcactattttcctgagtgattcttgggtctttcctctactcagaaccctaaattacatcccactcaaatcagctttgaagctctaatggggtttctaatgatcttctcacacccaataatccacccacaacatgttctcttttcttaaatataccagctcacaatctgctaaaaccacttgttcactaaaacctaatgtctctggcccagcacggtggctcacacctctgtaatcctagcactgtgggaagccgaggctggaggatcacttgaggtcaggagttggagaccagtctggctaacatggtgaaaccctgtctctgctaaaaatacaaaaattagtagggcagggtggtaggtgactgcaattccagctacttgggaggctgaggcaggagaatcacttgaacccaggaggcagaagttgcagtgagccatgggcgacagagtgagactctgtctcagagaaaaacaaaaacaaacaaaaaaaccctattttctctgatgtgaatatttatcaacacataatttacagttttcattcctattttcttaaattccttattagttataaattacatacagaataaagtaagtaagttatgaggaataatgctgtaatttacagccatgctcttaccacccaatttaagaaatactaccttactattaactttaatgtcttctgggtgtcgtttccaagtcccacactttttctactcctttagaggtaaacttcatcctgaattccttgtttatctctgccttctttttttagaaaaatgtttatttccataggttttggcgaacaggtggtatttggttacataaattctttggtggtgatttgagagaatctgatgcacccaccaccctagcagtatacactaaacccaatttttagtcttttacccttcaccccctcccaccttttcccccgagtccccaaagtccattgtatcattcttatgccttcatatctccatagcttagctcccacttatgagtgagaacacacgatgtttggttttctattcctgtgttgctttacttagaataacagcctccagttccatccagattgctgcaaatggcagtaatttgttcctttttatggctgagtagtagtccatcatatatatatacacaccataatttctttattcacttgctgattgatgggcctttgggctcgttccatatttttgcaattgtgaattgtgctgctataaatatgcacgtgcaagtatctttttcgtataatgacttcttttcctctgggtagatacccagtagtggggctgctggatcaaatggtagttctacttttagtttcttaaggaatcaccacactgttttccatagggttgtactagtttacattcccccaccagtgtagaagtgttccctttttaccagattcatgccaacattcattattttttgatttttttattatggccattctcatgggggtaaggtggtatagcaccgtggttttgatttgcatttccctgatcattagtgaagttgagcattttttcaaatgtttgttggtcatttgtatatcttcttttgagaattgtttattcatatgcttagcccactttttgatgtgattatttgtttttttcttgctaatttgtttgagttctttgtagattctcgattttagtcctttgacagatgtataaattgtgaagattttctcccactctgtgggttgtctgtttactctgctgtttcttttgctgcacagaagcttttttttctagttttatcccatgtatttttctttttatacaatatatcattcaattttgcaattaaatttacatgaaagaattcatactgtcagtatttttccagggcattatttttgttcagtgttaggtttctgaggttatcaatatttcaatatttcctatggccctaattcattttctctctctctctctgtctctgtcatttctctactgttgtatagtattccttttggtaaatatgctaccatttgtttatcctattaaaaatacaatgggtatttgtgttttttccaggaatcttttcaattccaatgtactacaatgaacaaacttgtatataccgtatggtacacatgtgtaaaaggttttttaagtgtgtacttcctggatcacagagtttgaacattttaagtttattagaaactgatgaattatttttcaaaatagtttttaccatgtacatttatatctgcattctacacaaattctatttgctcagaaatgccagcatttgatattaccaggctttgtaaaatgtaaattcaatgggttttatttgtatctcatgatgttttaacttgcatttcccactactaatgaggttgagcattttttcatgtgtttattcaccactcatgttttcccttgtgtaaagtgcttttactaggctttttattaattttctatttggtgttttgactctctttactatgatatgcatgagtttcctatatattcaagaaacaaatcctttgtcaaatttatggttcttttcactgtctttatgtggctttttatgaccagaaattcttaattttaatgaagcagaatttatcaattttgtattttaaggttagcgattttttatgtctggtttaagattatcctcccatattcttagctcaaaaagatattctattttattgctttctaaacattttatattttttcctttcatatttaggcaatagtaattgatttttttggtatggtgtaggtagatgttcaatttcatatttgtccttgtggataaccaatcattccatcattatttatttaagaatcagtctttccctcactgatctgctatgtcggctccatgtgtttatatatgtcaattgtatgcatgtacagttttgtcatatatacgtgtgtgtatttcatgttcattggtccctttcctatctctctaccattactacagccttaattaccacagctttaaaataaatattgataaggcaactttaccaacttcataccttttttccaagtgtatcatggctatgtttggcctttgttctattgtacaaattcagaatcagcttgtcaagcttcaggcatatacataaaaaatattggggattttattggaattacatggaatccataattatcttgaagataactgacatatttattatattgagtcttctaatttttctgtttatataaggtaactgtaaaatttttcaatacagttttataatttttttcattaaggtctttcaagtgttgtaatagattaccccttaatactttgtcttttatagtatgtaaataatatactttagactgtattttatacatatgattgttgtatagagatatacaattgaattttgtatactggctttgcattcaataaacttattaaactctcttattaattgtaataatctgtggatgctttacaattttttacatgaacccacatatcatcagcaattagtgacagttttatttcttctctctcatttctaaaattgctttcctgtcttactgcactgactaggacatctagtacaatattatataaagtttaatatagtgggtgtccttttaaattatctgatcttaaagcaagtgtgcccaatgtctcactagacatcatttcttgaagcattaggtataatgtttaatatagatttttgtaaatcttctttattaagtaaggaatttttcttctcttcctagttgctaaggcttttgtcacatatttgtcacctatgttgaatcagatgattttatgtctcacattctttaacctgggcatagtgacctgtgcccgctgaaccacaaggatgtaaaaactaaaactcatgttctggcagcaacaagtatctttaaggaacaagccaggtgcagtgttctttttccatttgatttcctgtttccactcaggtggaatgttcttcaaatcccttactttcttgctagttttatgttgcattctttaaaaggatacatttatattttatccagaatttttggttgttttcagtggtggatagctcagtgtatttagtccactgtgcaagaaatagaagttttccctttcctttctgtcaaaataatatccctcatttcttgaagcacatctcctttagatttccctttctatcatcatttggaaattttaactttgttcaatctagttatttatattactttccaaaccttctcctcccaactttccaatttcttaacagttttacatatttctttaagattgaggttggtcagttgtatgcatagactgttttgtcacatacttaaacctctttttgtgtatcccagagacaataatattttcagtttatgaaggcaaagtatgtgctctcttctcattttgacaaccttggaattcaataactacatattccagttgctgagtgcattttgttgctcctttagtaaacctggtatgatttatgatcaaatccttctagcttccttttctatataaatggaaaatatatcataggaaatttaataagtcctcctatgaacagaactctatttcatacaaatgtttatgcatactgaaaaattcttagcgaaaaatgaaaatcagaagaacatttcattctctttttgtttcatgaagcatttctggccagtcacagcggctcacacctataatcccaacacttcgggaggctgaggcaggagaattgcttgaggccagaagtttgagacagcctgggcctcctagccagacctcatttctacagaaaattttaaaaattagccaggcatagtggcacatgcctgtagtcctagctacttcagaggcagaggaaggaggattgtttgagaccaggagttcaaggttacagtgagcaacgatttccccactgcactccagcctgggcgacagagcaaaaccctgtcttttagggaaaaaagaaaagcatttttgattctcctcactttgctcaacattttgattgtttatagtactcatcgttttctaatatggtatatagtttttaattattatgtttgtttctcactgtcttcccccagtaaaatgtaagttccacaagggcagagatataatctgttttgtgcatgacatatcccaaacagtgcctgacatagagtaaatgctcaataaacatatgttgaatgaatcaatggtgtacaatatttgcataaacaaatagtaaaaagaaaaataaaagttcatgatttacttttctcagatggtttcgtattttcttaatcagtactgttttattttatgctttcagatatcaacatggcaggagagcccaaaccatacagaccaaaacctggaaacaagaggcccctttctgcactttacaggtaagtagataagcactgttttactctatatattagtgaaattttcttgcagctttataaggcaatataacttgtaaggcatccactatttaaaataataatccttattggaataaagtacaacaaatgttgttggtcaacatataaatatatcttgctgcattggcaaggatctcaatgcctaaccttctcatatctgcttatacaacccttctacgagatacttatctaataaaaatcactaatgactctacctgacaagtaggtggaaaggccaatgttggttaactttttttattttattttattttttgagatggagtctctctctgttgcccaggctggagtgcagtggcacaatctcagctcattgcaacttctgcctcccaggttcaagcgattctcctgcctcagcctcccgagaagctgggattgcaggtgcccaccaccacacccagctatcattattattattatttttagtagagacacggtttcaccatgttggccaggttgatctcgaacttctgacctcaggtgatctgcctgtctcagcctcccaaagtgctgggattacaggcatgagccaccacgcccagcccttggttgactattaactgcatgccatgttctttagctattttacatatgttgtttaatttaattttcacaagactcttgcaatgtagatattcctgttctcataatgcagctcaggaacctgagatgcagtttcttagtgattttttcaaggtcacaccactggttaacaatggcaccaatactcaaactcatgccctctgtaccttaaattccactcagtcagtcagccttctttattacaaagtacatgtttctctcatgaccatttttcccagacaacaaatatagtccttctcttctccagagagacagatccaattcctttaacctttcctgaagtgcttgggtctgagtcacttaacactctggtctttcccctctacgtgccccaatttgtcagtgtctatatctatgcggagaatccaggtgaagagatttagcacctttgttgttctgtatatacttctattatgttaagtagaattgagttgattttggggaagagtacaagagtaaacttatataactttcagttctttaagaacagccacttctgaaaaaattatgttctgctgttaaaccatatgtcccacttcatgtgcttttgccattagtttttgtactgtaagtgctgactttgtgtctattgctgtttaattctcttttgttagatatagccaattgttccaggctattgagatctcctgtcatcctatttatttggttttctcccagatacatatcatcagtccatcagtatctgcatctgaagagttaacataaaagtgttgagcaaggcttcctttttctctgatatcatttggataaaggagaattaagttatatgtgttaaaattgattattttctgatttagtatagtaagaagagtgctcaaaaatagcctggagcactttccttgtttttgttctctgaaaactagcatatcttcttttcagccacttatagcctcattttttgaactctaagatgagggtcagaactagatcacttctgaggtcctagtcatgcctagtaccccagggctctctactgtatggtattcagagatttttaaagctatactgaaaaatacatcataatttctcttattttggttgtttttgttttaataaaacattttcttaaaaatggaaagcaatagagtataacaaatgttgatagtgggtcatggggtaatattgacattaaagagcagagatgatgttatcaacaagaagcaaatgacacattctgtaccttgtttgaggtaaaggagatgatttataaaaccgagaaatttttatcagattcatttgtaaatgtatacattagagctgcagctaatgcagaacatttgaaaagtcttattttcaattactgctaaaacaagctgccaatggcttttttttatcatcaaagagttgctactgtctgtgcaatgatgttaattttcatattttctcttttcttggattgttttgattttcttatgagaatggaagctcatgacatgaatgtcattttcactattatttctctattactgttatattcaattgtgttcaaaagaactagaagcagaatttcatttaaatatgctatattgcatacaagccacattagtgagaaagtgcttatttatcctccttttatctgtttacacaaattaaggctgtacactgaaattgcaaaacagtaataaaggggatacaaaaacgtgaatgtatagctgaggaagcccttttatacacattttctcattctcacgtaagcttaagaaaaaaattaccttaattttatgtggacaaactatgctttcatagtcattcacctgttcatcagataactctacaaaattggtagtatatactatgctgtataaatgagaaacctgagtttccaagacaataaagggtttgttcaagacaagatcacaggattaggaaatgtgctcggttttcagccttcacgtctagtattctcaccactagattatagctccctgtatttagtcacttgctaccatctaaacaacacagatagggaaagtagagattttctgagcatcaaaccaatcatcaatactattactgtccatgaataccatgccagcaagtggcagaggaaatactatacaataaacactacataagaaaaaacagatataccacctatctgtgtgatcatagggcacaggttttaagcttcaagtaagtaagttctttttgtaacatagtagttgtataattttcctgagaggatagagttgcataaatgaggtaaaagcatttagttcaatgtagagaatatggtggcggcttggaaaagggatggtttttgctttcctgttctttgcatctctgagtctgtgttttgttttgttttgttttattttgcttttgagacagagtctcaatcggtcgctcaggctggagtgcagtgtcgtgatctcagctcagtgcaagctccgccttccaggttcatgccatacccctgcctcagcctcccgagtagctgggactacaggtgccggccaccacacctggctaattttttgtatttttagtagaggcagcatttcaccgtgttagccaggatagtctcgatctcctgacctcgtgatccgcccacttcggcctcccaaagcgctgggattacaggcgtgagccaccgcacccggcttctgagtctgttttcttatctgtaaaatgcgagagggggactctttttactcggtcattcattcattcatttatacaagatatatttagtgtgtatctactatggtctagggactgtaatagtgcttttctaggaaactagcatagaaaatggcaagaacagggtgaagagagagcataacgtaatgaaagtaagttatttgtatgaaggtagtctctgatttaccttcctgctctaaactgctatgtctctataactattctatttggaccactaagtgaactgccgccagactttcttcttcacgtacatccactttatctccaataccaatcacaaagtggtattcacatgaaatatccactgaggcataactttgatttgtttcttcttttaataggattttcaactcagccaaacaaccttcaataaggccttattatgtgctaagtaaacatggtatacatagaaaataaaacagtgagacttcaaaaagcttacagtcttatgcataagttagatgcacagatgaataaagacaactgagaagtatgcatacacttctgtaagagaataaatgaggaagttactgattctgcctagggagcagggagtaaaaacatctggaaagttaaaggaagaagacaacacttgagctgacttttgaagggaaagagagagggaagggcatctcatagtaggagctaggatagtctaccttgtggggaatggaaaactggggcattatggtgcccaggctgtgaatatatctatatatcaggttaaggagagctgacttttattctgtaggcaacaaggaaccacttaaacatggtgactgatcggaaatggggtgtgaggagagagagtcacaaatatgtccagggttttctagttcaggctactgagggaatgatcacatgagctgaatagaagaaataggaaacacatgataagcaatggcaggctcaggtgtaagatcgaggaaagggagcaaaaaggaattatttcagtcttggacatgaattcataaagacagacaattcattaaaatagcacttgcaataaaaatgtctcccattagagtctatttgtaaatgaaacataattaatcatttgtgaacatttcataaatattggacctggccctaatggtgaatagctaatccattctctagggaaaacattgtaacttttaataaattgctgcttcaaatacgttatgtacattacacaatatctgtggcactctaaaataataattctcccccaggaagtgagttttccagcatgccaactttcaattaatgctcaataattgctaaatgagaataattgtatgatggttttacttctatttgtaaagtagacagacctttcctctttgatggaaagctaacaaaaaatatcagagaacaaagacactatttataagagatgaacaacaatggattttttttcacctagaggtgactcccttctacttgcagggaactcaactcagtaagacatgtagtatatatagtttcatcccattgattctgtaaaaatcaatcatctggtactattgccaaatattgcttttggctatcatacaaatgcctcttgtagcaaccttcccatcccacccagatgaccatgagaatcaagattgtcacaagtcatttcaagagtctttaagattgtcagaagataacctacagttacagccaccattttaagatcatcacaattggtggtggtcaccatgaatgtgggttatattacagtaactccaatgataaaaaataactttcagagcacagaccaagtaaggtgactgcagcaaaatatctccggtgattcattcaccactggacctacgtgagttttgttttcttccttcatggtggctctagcacatcatgggaaaagggacccttgaatcacctaaaatgttccctagaaccttgaaagtagaaatgaaagtaatgtaagctaatttcagctaatgctaaatagcaaaaatcagtatgaaggaaaaacatcctggtcatcttcacttcattgacttatactgtttgctgagaaatgtttaccaattagctattgatcattttattcattttctgtctccttttataacatcaaggataacacacattccctttcagaagcttaatatttccattatcattatctccctttgcactggcaaaggcttccttccatttcacctacccagccagatggttccactcaaactacagtgtgaggaggagagggaaatattttctcctacccgccatattaatacatcctgtccttctgaaactgacacaagcccaaacactgacctgcctccctggtttactttgaatgtatgttattgcttaggtctacatagcaattgcagtctctttctgctcaggatcctatctttcctgtgcaaccaaattactaatgtatggttatcaagatccacaagagaaaataccaaaaacggtgtatatttctaaaactcaaacctgaatatccatacatctgggtaattgagggagagttctctaattcagaaatctccacaaatgaatgttgaaatgcttttgttctagaaaaggggtcaaacattcactttattgattgtttaaatttgtgcaaatgttttatgtgtgcttgttcagtttgcttggtgggaaaaatgttagacatacctcctaaaataacctgagcattatcagtgctttgaatttgatttttttgttcctcagctttttgggctgcataaaggaagatataaaatttcctaaaaggtaatgtatttaaggagcctgcaactattagagatactctacaaattttagttatcctcatcattatgattattcaaagaaaacatctatgataaagtattttaggaggtttttcttgttttttgtttgtttgtttgttttttaagacagggtctcgcttcatcacccaggctggagaacagtgggcgtgatctcagctcactgcaacctccgcctcccaggttcgagtgatcttcccacctcagtctcctgagtagctgggactacaggtgtgtgccaccatacctgtctaattcttttttgtatttttagtagagacaggatttcaccatgttgcccaggctggtctcaaactcccaagcttaagcaatctgcccgcctcagcctcccaaagtgctgggattacaggtgtgagccactgcttccagctttgaaaggttattttatatgtttttagctatgatgatgttgctaaatctcacacagtcaactaaacaggttaatgttttctataacttctttaaaaataaaattttttaaaagattattttacttatagtatgttcctcacattttaacactaagcaaatataacttatagaccttttatttaaaatgttcaaaaaagtgctgacacaatacccattaaatagttctgctgcgggcaattctctctgctaggctaaagaatggcctatttgcagttttctgttatgtttttaatgcatgaatatccattaatatcttctggcatatagaaagaatagagtagaggtagagggagaacttaatgcagagaatccatctctaagacctttgtggtttatgttgctagtcttcaggttatttgaaagactacattactatttgtttggtttgacatagtttatgataaaaatcaaaggaagtaaaaccatgcaatcaattttaaaaggagaaaagtagcaagagtcaataattcagtgggaattgagggaggtgggcaggtaggatcaagcaaatcaagcaaaaatttaattatactaataaaacttatgcagtcacaaagtattacatgagcacaacaaacttagccatgtgattcatggtagtcaaggcgaaaacaggagcaaaataatctatgtaaccatgtagtaaaagaaaatacttgaatatgtgtgagaagaaactatgttttcctaactctgttttctgatgtaaacttattatataggccttcataggaagtcatctaaacagcatagcaggtaccaccttgagtagcatttagacaatacgtgcatgctgtgcacacgcgcgcacacacacacacacacacacacacacacacaggttttaaagctgatgccatttttcttatgaactcaataaaagaatcacacgatattcctttcctttctgcttctcccaaggcagtttactatactgtgacaaatttatcatcctataaaattctaggagtagtgttccatgtagctagatctacagactaggccttcaaattaccacacagctgcatacttggaggagatagaaaggaaaagtgggctgaccccttgcttggcttatccactcagcttctaagtctagaagaaaaagacaatgcttgaatgtctagaacctgtaacagtgaccacttgagctgctacttaagactcctctttctttgaggtagggagaagtggaaaaggaatagtaaaccaagcatgggatagaaagggctgaaatttcacatcattcttacagttggcaggtgccaatgaagacaggcaactgattctttctaactgttggttttactacaccttggaaactgtagcctgtcatgaaattgttgctttcttttatatataaaagcatggttctgtgctgaagctaagatctcttcatcagcaggactcacattatgatcttttatgctatattctcctggcatctcactgtggggtattgcggttagagcaccaacaacagcgctagtccctactggagcttagcaggaacgtgtgcatctcatatgctaggtcattgcgcaagtgctccctgcctgggatgaagatgctttgtgggttttatcttgcaaagggcaatgcccttgcttgcttgtaagttgaagtatcttcattgtcagtgttgatttcatttgttttcattattttatgggtattgttcattgtctttctatccagtgacctgtttcttgttttaggacagtccttagtagagaatgtagggtcttgagcgtccaacctatgataaatttgtaagtccattgtttgttttaattttgaagtgttatctcattccctttgtgctcaccatatcaccttctccttctcaatctatccctgtattcaagattccaggatatgtttttccttccatattactgtatggagggtagcatgaaagaaattgaaatgtctctaaagatttatctctaaatgaatcaaattaaagactaaaaatttttaatgttccagtgttactctctcatcatactgttggggaaatgtaattaaaacaagtattttcccaagtcagaaatcctctccacaaagctaatagagaaagaaaaagcttgtattatcgaataaacattaagccaaaatgtggtgcacatcacaggcaacctaagagactgaagaccgaaagagatcttacctttttatgtagctaaacacatgcaacctattacatacatattttcaatataatcaacaagtagtcctcaagtaagaggattgacagcaccatttgtcatagatccttcattctaactgtttctggtaattggggtgaccatttatttatgttaggtaattgactttatgcaaaagaaaaacaaacttttcatattctcatgaaaggaggtagttctgcaatttggaataagcctcctgcccccactctgcctccccaggtccttgagaaagacattcccaggtcacaaagctgacaaaatgccaatctagtcttcaagtggattcatatgtatttaaaaaagaagatgaagtaattgcaattcacagttttctaaagtaaatccccaaatcaaaaggaagggagggaaatctctttctttattttcaatagggagaattaagccacctgtttttaatttgtatttgtccttggaagcacaaggaagaaaaatcaaggcagaaaaagtgagcaaccagccaggaagtctaaaagctagggctcaggttcaggtttcctgcctccaactctgaaatcattctgtgtttttcttctaattttaggtttttagggttttgtctcatttctttttaaacaatagtacaattggcagtgccatttaaggactgactactgaagattgatggaaagttcctcttttttcacgcattctctggcagttagaaccctgtgctccacctcctggttgctcctctaaagcccctgcagccacatcagggcttcttctataacacagtcttcacacatgcagagatgctttagcagcagacggaccgtgtaacttctaacaatgaaataaatggtaataaacaatttgacaatgtgtagaagaatgtttgagcccatataaaatgaggagaggagagaagaagaaatgaatattaacagtgtagatggacgtgattaatgagaaaccaaacagccctttttcctcggtcatctagtctcactcttacaatgtgaatgattttttaaagacatataaaatcatttacaaaattggcaaattctattacctttgtaaaaatgtatttttccctagtccattaaagtttgaaaatacttattacaaatcataagctagaagactttaggttatataaatatttttaatgttaattatgaacaagttctgcacggtagaaaagtggcttataggttttttaagtgttggttggttttaattatattaattagaaaataatctacaatttccttataaaacttacataaactgtttggtgtctttgtgagagtaattcttctgatggaattataagtactagaagtgaagctagataggcctcctttttccatgtttagacagaaggcaaaagggaacaccacaaagtctcactagattatcagttggctatgcatgatgaatgcttcacacgaaaattcattattttagaagttaattaactgttaaactttctaaatttctttctagtggaattataacatgattgataatttatttttattggtatttccaaatatcacaatacttagggatcttcttccaactctgagagttgacatctattttgcttatgtttattgtatgaaggaatcaaaagacaaggggcttgtttgaaataagcgtattacattggagctgaaactgagatgccacatagtttatgtagagtttgggggtgctttttgttttttataattttaacttttgttttagatgtagggggtacctgagcaggtctgttacctgggtatattgcatgatgatgagagtttatgttttaatatttgtttgacattatctcctcttcccactcagtcctgaagatttcagtgttcattagaagcactggactggaagtcaggaaacctgcaactaagttgtgtatctgctactacctgcccaaactaattaagtgattataaaaaaaaatcaacctctttaagccccattttctcatagtaaaatgaaggagttgaattaaaacacctcttactttatttccatttctaacattctgggattctgctgtttacttcccaatccagagactaaagtcagacatacatgctttattgttaagttaataccttttttccttcaaactcggtgcagtgtcttaaagtattcatgtcttttgactaattccatcctttgaagtatatctaaggagataattttaaatatttttaaaaacatttttaaaaaattaaatttttccaagatgttctttgcagttttatttataatagtgagtaatttatttataatagtgagtaatctgatccaaccaaaatattaagcagtaatgggtatggtgcacctattagatgaaatgttcacaaagtgttaataatgacatgaaaaaacttagcatttgattagagaaaaaaacattttaagttctgggatacatgtacaggacgtgcaggtttgttacataggtaaatgtgtgccatggtagtttgctgcacctatcaacccatcacctaggtattaagcccagcatgcattacctatttattctgatgctctccctctccccacctcaccgcccataggcccgagtgtgttttgttccccacctgtatccatgtgttctcattgttcagctcccacttgtaagtgagaacatgtggtatttggttttctgttcctgtgttagtttgctgaggataatgacttctagctccatccatgtccctgcaaaggatatgatctcatttttttatggcagcatagtattccacagtatacgtataccacatttcttttatctagtctatcattaatgggcatttggtttgattccatgtatttgctattgtgaatggtgctgcaatgaacatatgtgtgcatgtatccttataatagaacgatttctattcctttgggtatatacctagtaatggggttgctgggtcaaatagtatttctggttccaggtctttgaggaatcgccacactgtcttccatgatgtttgaactaatttacattcccaccaacagtgtaaaagagttcttatttctccacagcctcgccagcatctgttgtttcttgtttttttaataactgccattctgactggcatgagatgatatctcattgtggttttgatttgcatttctctaatgaccagtgatgatgagctttattccatgtgttcgctggctgcataaatgtcttcttttgagaagtgtctgttcatgtcctttacctactttttaatagagttgtttgtttttttcttgtaaatttgtttaagttccttgtagattctagatattagacctttgtcagatggttagattgcaaaaattttctcccattctgtaagttgtctgttcactctgataatagttgcttttgctgtgcagaaaatctttagttttatgagaacccatttgtcaattttggcttttgctgtgattgcttttggttaaaaggaattatataaacatcatgaccaaaactacttaacaaataaaatatatgcagagaaaaaaatagagcaaaatattaactgtaattttctttgtatggtgggaatatagataaatttttctttaagcttttttaaaaattatacttcaagttctgtgatacatgtgcagaacatgcaggtttgttacataggtatacacatgctatggtggtttgctgcacccatcaacccgtcatctacattaggtatttctcctaatgcaatccctcccctagccccccacccccaaacagaccccggcgtgtgatgttcccctctctgtgtccatgtgttctcattgtccaactcccacttatgagtgagaacatgcggtgtttggttttctgttcctgtgttagtttgatgagaatgatggtttccagcttcatccatgtccctgcaaaggacatgaactcatcttttttatggctgcatagtattccattgtgtatatgtgccacattatctttgtccagtattactggattcagtattactgaagggcatttgggttggttccaagtctttgctattgtgaacagtgctgcagtaaacatacatgcgcatgtgtctttatagtagaatgatttataatcctttgggtatatccccagtaatgggattgctgagtcaaatgatatttctggttctagatccttgaggaattgccacactgtcttccacaatggttgaactaatttacactcccaccaacagtgtaaaagtgtttctatttctccacatcctctccagtatctgttgtttcctgacattttaatgatcgccattctaactggtgtgagatggtgtctcattgtggttttgatttgcatttctctaatgaccagtgatggtgagctttgtttcatatgtctgttggccacataaatgtcttcttttgagaagtgtctgttcatatcctttgcccactttttgatggggttgtttttttcttgtaaatttgtttaagttctttgtagattctggatattagcccattgtcagatgagtagattgcaaaaattttcccccattctgtaggttgcctgttacctctgatgatagtttctttagctgtgcagaagctctttagtttagttagatcccatttgttaatgttggcttttgttgccattgcttttggtgttttaatcatgcagtctttgcccatgtctatgtcctgaatggtattgcctagtttttctcctagggtttttatggttttaggtcttatgtttaagtctttaatccatcttgagtcagtttttgtataaggtgtaaggaaggggtccaaaacagcatggtactggtaccaaaacagatatataggccaatggaacagaacagatgtctacaaccatatgatctttgacaaacctgacaaaaacaagccatcgggaaaggattccctatttaataaatgacgtcgagaaaactggctacccatatgcagataatatttttcttataactttaatacataatgcaatttttctttaaagagaattttataaccaaaaaatgatgtattttaaaattagacattttcagtgaaaaatgacaaacaccatacaaatgactcatgcaggcaatagtgaaggttttgggaggtggggctggtgttaagcaaagccagtgaaacacatacagcacttaatctttagtactagactgctttagtctccatggttattagaaaagttaattttctaaaagggcaacttcattaacattagtctcacagttcagcgcagtccagtgaccctgtgtggaggcatagttcctactagagctaactgcaggaagtggcctatcagtcagcccaggccaggacagaatgccgagttcagtatgcagagcgaagggcaaggagcaggatatgggggccaggagagcagctgaagtcgtctaatcttcaaaaagaaaaaagtcaaaatatctgagcctttaagtggtgcagtggaatgagcaatcaggaatgtgtgctaaaggcagttcttatgactgcagattagtgagcaggtaggaagacaattgtgcctgcctaataataactgccccctggtatttaaagctgtaattcagctgctttgctgctgctttgaaaggacatagcgtgtgtgagctaaaagagtaacggaataaagtccaggttgtagccttagtatgcagagcgtgggacatgacagaaaaacaggagacacatgatgtattcctaactcagagaatctatcatcaatgcagagcaacaaatggtaatgagtctgagttcagtaaatgtatcagaatgtactttttaagaatgtgatacaccaaccaatagctgagtttgaaaaggaaacagaagatgacccacaaattacagataatcaagagtgaaaaagcattttgagttgaattacttagcaattgttaaaggtagtttaaatgctatcttactaaaactatctacaacatcagtggcaaagacacttatgatactgtgagaattcaggaagaatttaaatggaattgtaacataattttatgatttgttgaagattatctttttctcatttttttccttactctttgttactccaactcaatatagcaaatctcatgtttagaggatcgaaaaaaaaacattatatgatctcattgaaaatatgggctgggtgcggtggttcacacctataatcccagtacttcgggaggctaaagcaggcagattacttgagcccaggagttcgagaccagcttgggcaacatggtgaaaccccatctttacaaaaaatacaaaaattagtcgggtgtggtcatgtacacttgtagtcccagctactcagaaggctgaggtgggaggatcacttgagcctacttgcagtttgaagctccatgagctgtaatcactccagccagagccacagagtgagaccctgtttcaaaaaagaaaaagaataaaagaaatatgaactaaattgagtatagaaaagttgcaatatttggcattagaaaataaagatattatgaaagaaataagtaatatcaggtatccattttaactgaaaaagcaaatgtattatgtttttaaatgtaatgctaatgaaataaaagcaagaaagactagtcttaggggtaggtgaagcacatatagacaggcagttagtagtctcactggagtgagttgccatctggggagccagtcagtgtgttacaagtttcttggtcatacaataaagtccagaacaaagctccagtcctggaatgttaattgaaaaaagcagggcaagctagtcagctggtcttcatgagggattgtggggtggcagccattagaacttaagagccaagacagccaaattttagggacaaaccaaattggtggcaagagagatgaaacgcaaaataaatatttcacatacggtcagccctgagggtctatgtaggaacaatggagacttgcaaaagaatttctaatcccagcatttggagcagatcatgggatctgaagcctggagggatgacttacctcttagcttctatgaacagagtttgcccaaagactgaccaaattcagcctatattaaagattcttaatggatctggtgcagaaggaaacataaatttgtggatgtagtcatttattcatcaattaactattaagcacccactggacatttttctgggtaccaaggatatcccagttaatgctacaagaaaatctttagctgaattaaatgtaaaagaatttaattgagcaaaaaacgatttgcaaattgggcagtgtctcaagccagagtacattcagagattccagtgcagttacattgtggaagaagattcatggaaaaaaaagagaaagtgatgtacagaaaatagaagtgagatccagaagtagcggattggttacagcttcacatctgccttatttgaacatggtttgaacagttgaccacctttgattggccagaacttggtgattgccacaagagtaagctacggtctgtttacaatttcatttaggttataattcaccgtgtactgagaaacctttaggctgaacttaaaatatgtaaagaggcaactttaggctaaatttgatttatgacaaagtagacaaaaatctctgtccttgccttcaagtttgaggtaactaaagacaaacaaaagcaaactaattataaattagaaggtagtagatgttatagaaaaaaattaagctagaagattttggaagtaggaagatgacaagtactgcaattttttatagggtgctcaatgaaggctcagctgagaacatgacatttgagcagccgtgaagggggtgatgagcaggcaaagtgatgcctggggaaaagcattctaggtaggggaactttgctagcaaaggccctaaagcagaagcattctcatgtgttttaaaaagcaaggatgccaatgtttctagagaaaactcacaaaactttgggcaaggaggaaatgagaggaataatggcagagatgtaaatggaggcaccaaatgatgtaaaagcctcacaggcctttgaagcactttgggtttcactctgagtaaaataaagagcttttggaaggttttaagcagaagagtaccatgacagaacttaaattctgaaaagtcccattagccatatgttgacaatggattgtggagtgttagggtagaatgtgggagaccaggcaggagatggtgatgtggttaaacggtagcaactgagatgtcaaataaaaatggttatgttactgattgattttgaaagtagtgccaacaagtttattaacaaattggaagtggactgtgaaagaaagaatggagttgaggataaacacattatctgctgctacgtagcaagatttattaacttaaaaaaaaacatttttgtcatattcagcgatgtgggctgagttcagtcaaatagttctgctctgtgtgtcccagattgctttggcactaacagagtgaaacaggagagttccctgtttcccccccggcaggatgtgacagggtgtgtctccttctgtctgttcagccaccgtatgtgtgcactcaaaccccttaagggagggggagcatgcaaacaggcaggtgcagaagccaaagcaagcacccctggtctctggccccaggccagcatccagggaagggagctgagactcccaaagcccaagtggacatgtgttacagtgcactcctttagccttgccatctgaagacagcttaagtgttaactagctcagtaccctcttggtacccgggtccttgtccagcatccaggaagaatcaggtcacacacagacttgaaagatgaatgcggggttttgttgagtcctggaggtggctctcagtgggatggatggggagatggaagggggatggagtgggaagatgatcttcccctggagtttggccacccagcggccaatctcctttccaactgtccccagccaaactcctcttggtgtacggacacttcttctcttctctctgctgcaccgttctgcctttcttctgctcttctgtttgtcctctcatctccccctggagctggtggtttggagtttacatgggtacaggatagggggcgttgcaggccaaaaggcaaatttgggcatgaaaacaggaatgccttttctcatttagggccacgggtttccaggcttaagggtgggcccttcgctggggaaccaccttcttcgacccagtactcccgtgtgttctgtccatatcaacagcatgtaaggttggaagctgaggttggcaggaatggctgtggtggctgagcctttttcttcacatagtctctccctggggccagcttaggttttatcacattatggtagtctcaaagcagttagagtttgtatatgatgactgacttcaagagagaggaagaagctgtttgtactcttcaaacctggattgcaagttccagaatgtcccatctgccacatcacattctttgtataagagcaagtcacaaggaaatagattccacctcttgatgggtgaggggaagaaactgatgatagccagactgtctaccagagatgtctccaaggtttttggaccaagcaactggacatatgaagttgcagttaagtgtgatgggaaagactgacagaagttagagtaggccaaggtgggtggtgagtaaagatatcatataggcaattgaatatctaatctggagttcaggggagagatctggactgaatgtgcctatttgtgagtcatcagtatatagatggtattcaaagccacaagactgggtgagaacagaaaggggataagaaaagatagaaaagagaagaattccaaggactgagctctacaacactctcaaatttgaagtcaagaaccagcaaaggtgactgggaggaagcaactagtgaggtagttaggctgggtggtatgaaactcagggaagaagatgtttcaagaagaattaatcaattgggtcaactgctcttcaaagttcatgttaactaataattcatcattgaacttagcattgtggagaccattcgagacattgacaaaaacaaacaagactttgaatccatcgggtttggtgttatggcttgatcctgcacaattatctcagagagcattccaggaggggatgtagaattataaacctacatcagtataagatagatacagctctatagagtgggagggattctaatgtgaagccaaaatgcagccttgccagtcacttggagcttccaacacaatccaggagtagataatattcaataatccaggtaggtgactggtatcacacaattttgtcaacctgtggcagtttaaataattacattctaaaattaagtgccaagatttaatgccttcagagaacaagggtccaggggagggtgggaaagcttggttagagaggggctgtggttaccaaaacaaaaactcagacaagaaattaaccagccagaccagtatgtgactgggaagagggaagaaacacagctaagcaaaacacacgtaaaaatgagttgtagttcaccaagtctatgtcagacattagctatgacttggtctgaatgagtttcaaatgttttattaagagaaaggatcagagatggtgaggttgaagctgggacctgatgggtatgagactgtggggcacaggtgaagagtatggaatggatggggggcagcagggagatacatggaaggacacacaagtcagctgctcctcccaacctactaggccagggccttgaaaatacatagatcatgtcatttagcaccatttacactctgcacaacttattaggatgggcgatcaaaagactacagagtattgactcttatatcttcatcttaaagtggagtaaaagataaatggcatcggcattctgcaaagagcaggactgaggatgaagatctgaaactggataactctgactgattacctccttccccaggctgcactcttgacagaaggcacagtttctctgtaggatttaacagccattagcaagcaactaagacaattgaaagagacagctgagcagccacatgctagtttttcttaaatttacttccctttacaagtctggaactgagatgagcaaatcttgctacatgaaaataattaagtttgaaagtatttcttttcagaaaatcatttttcttaatagaaacatctgcagaattgtgtggactcccttccagtgtgaggagcagtaaagttaatcctgtaatcatattggagaaaggatgagaccccactctttaccctaaccaaatatcttccagcaccatcctcactgctgcccccaaagctgttggagcatttcaattatcctaggagaatctgccagtggttaatgatctttcttgccaggaggttctttatccttcacctccattcctgttgctacagttcattcctccctgtagaattatgaaagaacattacagtccatccgagggagatgagccctgcagccttaatttccaatgtggcaaaagtcatgagtctgagtgtcagaactgccacagagattcttggttgataccacagccatccattaacctgtccctggagttagcagcccagatggtggtaactgcaaatgaaacttaccaaggggcttgatgatagccctaagcagagatttcagttgcagagatttcagttgagcatgaaagcctttgaaaaagatatcacaggaaatagaggggaaagctgcattttactccagagaaattgattctatataggaaaatcccataggaatgaaggagcctggctgtctcctcaaccttgtaggtaaatatgatgttcttctaatgatcaacaaataaagtattagaaaatagtataaatattctaaaatattaagactcaatgtcttaatcagactgcctgagttatcaccctgctctatgtcttcctagctctaagagcctgagaaagtttactgattcctttttatctctgtttttgtcatttataaaatagacatgataatgatgtcaacttcacaagaaagttatgaggattaaatatgtgaaaatgcttaaaatagagtgtcaaattctaaatattggctgtcatacatggggcattaaatatacattattatttgtacattggtttatggactatatgtctggaaatctaagttgtactgtggattttataccttttcattacttttgtagccttgagcaaatttctgtaccttccattagcacaagttggtaaatacgtatttggacataatgcttttcatttttcttcttattcctgtggcagacataggttaattacaggcccttacaccctgaggcctaagtaggctttagaattcatgtcaacatgatgttcccagcagccaccatcagtcagttgacatgaaaatcaaaactgatttgacctctcagctttagagctcacaagcttttaaaggaatgtttattcgcactttcagccacctcagactatcccatcacagtatcacccccactttgccaccaatttttcaatgttgataggacaccacaaatgtctgcatttgggataatctttgtgtattcatcataacactacacccttgtaagtagccacagctggagaagggatatggctggcacgagagtccactgtgagtacatgcttgaggtcagtatccaactatatcttgaccaaagaagctgactgacagggcatgctcagacttctttgcgcagatggaggtgaggaggtcagtgcctgtacagaccaaccagtgcttcttcccatgctatgctctaaggaagcttcctcctaataaatcttttgctctccacaacaaaaccctaataatgtgtctcctaggcatcttggcccaggccagccagcacagaagcctgggattgttttgtttagttttcaggttaggggacaagaataaccaagagaataagtaccaccgacagattctgatctttggtagatctcagaattcacctacagttatccatgaatatcctttccctattacataaagaagactctttctttattaaatctttaggcaataaatgaatttttaagaatactgataggattatgttatgttttaatatgcaaaatattctgtaagaagacacctaagaatcacttacaagtgcttatctttgatcagtcatcatctgttgctcccatttaaccatttaccttgtaacaaagcttttttaaatcagaatgccttggaatgattaaaatgtcatatggatgtgtttagattacaaatagttaaggatgagatataaactaaattttaaatatcaaaacaagatttctataattcttaagtatattaagttatttataaaatatcatgctaaattattgcataaacaacaagcaatcagttagctaaggaataacttaaaatagcctgggccaccatcatacccagtgtggggccagatagatgaaatatatggccagtgtagcatttattgtgttctttatcttttcttaagagtacagaacagtggctgtatagactttggagttagacctgtgactgaattcagactccgtcactttgctgtgtgtcttagttcgtttcctgctactatcacagagtaacactgactggatgatttataaaaaatgtaagttatttggctcacagttctagagactgagaagtccaaaatcaagaggcagtgtctagtgagggatttcttgttgcatcataatatggtggaaagcatcacatggtgaagaaacgcatgcacaaaacagagcgaaaaagcagatcaaatccacatctgcaataatgacataaatccattcatgagggtaaagtcctcatggcctaatcatctcttaaaggtctcactttttactaccatcacaatggcaattaaacttcaacgtgagttttagagaggacattcagataacagcactgtgtggctttaaacaaattactaggtttttctgaactttagttttcttatatactgttgtcaaaattccatgtgtgagagagcttggcagagtccctggcacatcgcaagctctgactcttgtgataattgttagactccctcgttgtttgcggaagtgtggtggggacagataggaatcagccacattgtttttttctacataaaatatttgcacccacattggtctttaaaactctttgaaatgcatatgaaaattcctttggagaaaaaaagtatgcagttaaaaaaaaagaagtcctgtattccctattaagagattaattcctaaagggtagacaaacaagatttcaaacatcactagatttggacactagctttggcctgtaaatcgactttagtggagaatgttaacacttctcaattcctactccttgctggcttgagtaaggcacacaggagccactttcagagataatcttctcttctttatttacttttatcctacagaacagattgaaagccagtggcatagatctaggcacaggttttctcagtcagtcaacatttggggagcatctgctatgtgttgggtgccatgccaggtacaggttaatgcaactgccagaacagatcttctgcccccttctgaactttgcttctacacatctaaggtcctgttagtgagcccaaataaatattcttcactccactcttttcttcttattcttcactatctctgggcgaacttattctctcttatgatttaatatactaattctgcattgataacatgactcctgaatctatttccagcccaaatgtctcacctgagctttgagcccacatttccatctgctgagtactgcatatcttctccaatatatcccaacctattccccaacctgaactctctatttctattaactggctatgaatgcaggaacaaggattcgaggactcagagattaaaaaaaaaaagtaataacaatgatggttaatatttattaaccatttatccactatttatttaagttatttagttatctaatgtgtgtagttatatatttatttctcacagtagctctttgagataggtctactattatttccattttgcaaatgaaataattgaggcacaaagagaagtcccttacttctccaaggccacacagccagaggtggtggagtcatgactggaattaggcaatctgattctagaacctgtacacttaagccctttggcacatccatcttaaatgtaggtcagggcttgggttgtcatagctaaaaagaacagatcagataatggtaagtagtatcactgcctggaaattttaactacaaaattctgtaaatataatgggtggatatttttataacatgctttggattcatgataaagctctagtctttcaaaagcttgtgaaattatttctgcaaaaacacacatatgccgaagcacaagagaaaaagcaggatgcgggaaagcaaaatgccaatgcacaggggaaaaagcaagatgccacccagacagtgagcaatttgctcagcttggctggagcgtggagtctgtagactgaagtcatagaagacaaaggctgagaaggtacactggaacctgattgtgaatgaacttttagttatattaatactataaatatagtaataaagttatattggattgtactctgtaggcaaaacatgggactagaagttggggagcaaggcagggaaggttcatctaacacaatcattactgagagcctccagtgaagtaggcatgattctaggtacttgaaatacagtttgtttgtacctccaaggagtgtgcagtcttagggggagcttggcaattacactggaaatttttaattcaccacggttaagtgttacagagtgctatgaaaatagttatgaagtaccactaacaaacccattgtgccttataagaaaatacttcctggaaacatgcagagatttgtaacgaggagaattacatgattatatttgtattttagaaatttaattctgttagtagatatggcaacaccaaagaaatactgaagaaggaaggtcattgaagagattaatggatcatataaaagttgatgatcacttgaactgtgaaaataagaattgagaggcaagtacagaatcaagaggacttttggcaacagcaacaacagaactagaaatgttgttggaaaggagttcatgagaatgattccagtctttctttttagtttggtcacctaagtggctgagttttccaagttagggaaaaacaaggaagagcaaaataagcgaggaagggccgggtgcgctggctcacgcctgtaatcccagcactttgggaggccgaggcaggcggatcacgaggtcaggagatcgagaccatcctggctaacacggtgaaaccccgtctctactaaaaatacaaaaaattaaccaggcgtggtggcaggcacctgtagtcccagctactcgggaggctgaggcaggagaatggcgtgaacccggaaggtggagtttgcagtgagccgagatcacgccactgcactccagcctgcctgggcaacagagcaagactctgtctcaaaaataaataaataaataaaataagggaggaagacagtaaatttagtttgagatatgttagcttagaggcatctacaattagagatatttcgtgggcagctatagccacctatcataaatagaatgatgccagagatgtaagttttggaatttccaacatctgaatccaggtgagctttctcaatagagcatagaagtataaagacagacaatctgacagtaccttgaggcacatgtaaacaaagcaaaacaaataaaatagatgacacatgaactttagagtcagaatgtctgaattcaaatcccagctcaaccacttatgagctttgtgattttggacaaggtacttcatatcttttggtctcagtttcctcatctataaaatgagaactacctcagattgtatcatgacgtttaaataaattagtgtttataaagaatgttgaataatacctggccttcagtaaatacaatttagtttttattaaataaaaagtattataattcatttagctccaaatattgaccttcattctgtgttctattttatttctccactatgtcttactcttctgaaggctgtcgtttgtttatcttattctactcctaattctagtgggtcctgaatgaagtattattaaattcactacctatttcacatgaaaagtaaatcttaggaaagataaaaaaaattcctttcttcatgaaacaattaccttgtaaaaaaatcttagaaaagttctctctaggcatatcacaatgtaatgatccgtttctacagattaaattgataaataattttctacaaaggaatattcctcctagcagtttccttcttttacttttttttcatttttcaggaccaacactactaaaatgatctattcatacatttcaagcagtttcagactttagaattaacctgtttctggtatggtcgtgaccatcaggatccactctgccaggaacagtgctagatgctctaaatagaaaatctcatattcttccccaaactccttgagttggctatgatgtttgctatataattgagaaaaatgaggttattcagagtccctgaatcataccaagcctagagaagctgcctcaatatagtgaacaacagctaagcagttggtttcaaagcagagcatcattcaacacgggccagttgtctctccactctacagtgtgtcatcatcattttgaggatgagacaaaaggtagagtggcctgatgggggcacccaccaagatttcctgccctattatttcaccacagaagacacttgggagtcctggtaccttggccttatcatctatggcttggaggaaccaatgaccaataatctttttttctttcagctcagttcatgaaccatcggcaacattctcccctctagacccatcatcagaagacttaacacaaaactgttggaagtctcttgtctaaacagagtacaggtttaatattcttaccagtcttaatgagactctaagttcagttttttttaattgaataacattgttcagaggatatgtcatagtgatggtgatgataagtattacctcagagatgggcttttccctgtaaaatgaaggcttcaagatcagctttaagaaggagttagattgagataaatgtaaatgataaatagatcatgcatgggaaaaaacagtattctggtatagatatataatgctaagtgtaccaaagcaaagccaaatcagatgtgtctggacaatacttagtttttctggaatgaagtgtttattgtttagttagagaagcagtaaagaatgacatggaaaactggtgagggcatgtttgtgaagatcttaaaagtttgggtaccatcttcttatgattaatgaaatcaagaaaggtggtaacacaaaaacatttcaggtgaatatgttagtaggatcagaggttgaaatggtgatgtagagaaggaattcaaattattctgaatttctaaatctaggaaaataaataacttgatatgtattaaaagtaaagaaagcctattttaggaggttgtttccaattccttccaacaaaataatatctcacacactggcatactttttctataaaggccacatagcaaatattttaggattttggacatgcagtctgctctgccacaactactcaacttgttgccgtagcacaaagcagccttaaacaatatgtaaatgaagtcacatggctctgtttcagtaagctttatttacggacactgaagtttgaatttcatgaattttcatgtgtcacaaaatattattactcttcttttgatattttccagctactttaaaatgtaaaaaccattcttagcttggggctatacacaatcagagggtgagcaggatttggccacagtttgcaaactcttggtttatagaacatcatcagaactttcaatccaacatcattttgaaaactttgaatttcttctgaagtcttctcttgagcatttggaaggagctggttgaagtgggcttgaagtggtaggagaaggggacaactattaataactagctagtcagacaaatcatactaaccacagggggcagtaggacaatatatgtccctgtatgctctaatccaacagttgcttgtctgaaaccttcaaaaaaaaagagagagagagagaaatcaatcaataaatactactgcaaacaaacacattctgaactcagtattttgataattgcagagggaaaatcaaaagtggtgggctttgcttttattcaagttgcttatgccaccctaaagtggtgcaatgcagtacttgcccaaaggaagtgagtggcagcattgatggaagcttagtgtgagagcagtgtgtaaagttgaagtgactttgaacaaagaatttcggagagactaactaggctggggtaactaatgaaaaccaggctgggaatggaatgcagagggggacatgagagtcccaaaggaaaaattgatgggacttgctaactaatgagacatggaggctgaaaaaagagagaggagaaagatataaaacctttcaaaagattctcattatattattcagtgccactaagaatcacataccagtgagaggcaagggggacgatgtagtgtatagaaaatggggaacataggaagctggagagtagcacttcaaacaagcaaatcacacacatacactaatgtctgataaatgtcaggctgaaattattggcaaatacagagagaagggatcccattaatgcccacatgctatctttatttcaagtattatcaggtggaaaataaagtagtaccattatcgtgttgatggtctaaatatgtgaacaatctcctgcatcatattatgtagaatccccctcatttcttcaaggcaatttccttttgatcacttggcactggtcatgtcttataaagcaaatatatccaaacatttttcgttgcttcagcttttccctccctagttctgtttgcttatgtagatcacaaatgtatgagaaaaacaaacacaataaggcaattaatgtacctacagttagagatgtgaataatattggaattcagaaaaggaaaggttacataaataaacctctccaaactcttagcaccaactattggttttatctgcttctaccctacctagagctgtccaaagggattgctaaggcacttgcttcctaaaaatcccttttctgccattatgattcacccaaagcagcatggtatatggcggagatgcatgtcagctctgcctataaatgcaccaaggcatatttctcataagcacatttttgcctacacagaatgaaatagagacaaaaaagtaattagtgccttcgttgtttggactcacatttataaaaataaatgtttagcctaattctaagatagtcatttcaactgtctttcttaaaaatcttaaacaccaggatttagttaaaaatatcttcagttcgcctacatttcacccttaattgtatcttaagaaacctataatgaaactagcgtggccaaaatacacttaccaacaggtttccttaattattatctaggaactatttagaagtggatgctttcctgatttacttacatgttgtaaaaaaaatggaaagttaatttatgaaattagaaaagtagctgaaagtaagcctagcccattttataatgagaaaaataaaacacagaatatgttttaaagtggctttctcaaatgaaccacaaccttcaggattagactttccctttgagatattgaggtacagaaaataccaagtttttagaagcacaaaggaggctgaaggacccaaatttgtgagctgacactaccccaccctaaggggtgttaagaccaataaataactatatatggtatgctgcttctctcttctgagtaaatcagttattcaactaacatgtaacaagcacattataaattatttcactattacaacaaccacaaatagatatatagaaacgtctacaaacaaattaccatgtataaagaaaatgagtagatacagagagtgcaatcagaattagattaatactatgatcatcttaatatatcagttaaatgttatgtcctcattccaagactctcattttatttagcttctgcattaatccagctgcaaattgaattagtccagattaggtcttagtatattatttatagctttttactggtgctacattatgcattttcatccaaacaagtataataattttgtcaggttcatgtaaaagcaatttttgaatatacagcaaatttttatattaaaagaaaattttcatattttttcatagacttgaatcaaaggaacctttcctgtctgttgggtaagtatatatttaaatactttaagtattaattatttaattcaaatttccaagaacttctgagatggtattttcagtcatttaacatcatattcaaaatcataacatatcagtgcatgcaacattgctatctatgttttataaagacttaactaaaatgctccctaggttgtattgtgacctcagaaatgcagctaatgaatgtatatgaaatcctgtatcttccataaaggctaaacaaggtacacagtgatcatccatattctcttcatgtaaaaatatactcagattggttttaaaaattcctctgagccatagctccaccattccaagcctgtctacccattgccattctccatttcttttcaatctactctattcactgtttcgtcacccacttccctaagtctgtcttcacaatcaatatctatcttttctccttatctctcatttcactttaatttctccagttcactcacattgactgcttctttgcacccaaagctgaggaaccctgaggcaaatttagataagacgaacgcttgcctgctctgatggtatccttcttagtcacaatacatatctttaagaataatatattgttggccaggcgcggtggttcatgcctgtaatcctagcatttttgggaggtgggcggatcacctgagggcaggagctcaagaccggcctggccaacatggtgaaactctgtctctattaaaaatacaaaaattagctgggcatggtggcacacacctgtaatcccagctacttgggaggctgaggcaggagaattgcctgaacctgggaggcagaagttgcagtgagccaagatcacaccactgcactccactccagcctgggtgacagagcaagactctgtcccaaaaagtaatagtaataaaataataacaataatatgtttttgacatgagtgcacatgttctatttttaggcatttcaaactaagaataagcaatgttgtttgtatctgatcaaatactcctttgactaacatattaaagtgtattatgaaaggacttttgcactttcaatattatagatgatattgtatgaaaaagttgtgaaaaatgcaatgtcttgcctagagaaatcatgctatatttgatgagggaaaaaaagctgtcatatataggcagccacaatactgatgcttaatgaccagaaacatggaatggggttagatttttaagtgaccagatcaattttcttttattactttgtacatggtcattgaatatttctatcaatcactcattcaacaacatggttcccaattcctttctactcttcataaaagcttttcagaaagccactcaaatcatggaaatcaaaataattattaggggatgtggaagacaaaaaatggaatatatgcatttatttgaagactacatggaaaatgaaaggtcgagttggtctggcccaaaaaaagtgataaagcatgcttttttccctacattgatcatcagctcctattgttaaaaatctctacacctgaagaaatcttttagtttgaatgcatgtgtatttgccctcaagtcaaaaggcctgaaatagcttctcttcacgcctcacttcatgtagtttctgtgcagcctttactgttctcctggctattatgagatggaattccttttttattgcatacttctgttttaaaaggcagaccctaagtaatctttgttttaaatttatcaacagtttagcactgattattagaaccctgagaaaatctctccaaaaaaaaaaaaaaatactgtatcgctcagccaatgctcaaagtgggaaaattagcatggcacacataagatactgcttatgtcttaaaagtaaagtggtgtgaaaggcaacccaaatgattctgctgaatggatattttaatttatagctaaatgtttctgttccctcaagaaaattattttaaataagattgtccaaaagtatgtatgctaaggtgggcgactcacttgagttcaggagttcgagaccaggctggacaacatggtgaaacatcatctctacaaaaaattacaaaaattagctggccgtggtgccgtgcctctagtcctagccacctggggggctgaggcgggaggatcatttgagcccagcaggtccgggctacaatgaaccgagatcgcaccacttcaccccagcgtaggcaacaaagtgagaccctgtctcaaaaaaataaaagcatgtatgtagctctctgctgcctttttcagtgagaagatgtaagttctttagtggtgattggtgagattttggtgcgcccatcacccaagcagtatacactgcatcatatttgtggtcttttagccctcacccccctcccaaccttcccacccaaccaagtccccaaagtccattgtatcattcttatgcttttccatcctcatagcttagctcccacttatcagtgaacacatacgatgtttggttttccattcctgagttacttcacttagaataatagtctccagtctcatccaggttactgcaaacgccgttaatttgtttctttttatggctgattagtattccatcatataaatatacaccacaatttctttatccactctttgattgttgggcatttgggttggttctatgattttgcaattgcgaattctgctgctataaacatgcatgtgcaagtatctttttcatataatgacttcttttcctctgggtggatacccagagtgggattgctggatcaaatggtagttctactattagttctttaaagaatctttacactgttttctatagtggttgtactagtttacattcccaccagcagtgtagaagtgttccctattcactgcatccactccaccatctactgttttttgattttttgattatggccatttttgcagaagtaagctagtattgcattatggttttgatttgcatttgcctgatcattagtgatgttaagcattttttcatatgtttcttggccatttgtatatcttcatttgagtactatctattcatgtaattaacccactttttgatgggatgtttgtgtttttcttactgatttgattgagttcattgtagattctggatattagtcctttgttagatgtatagattgtgaagattttctcccactctgtgggttgtctgttcactctcttctttttgccatgcaaaagctctttagtttaattaagtctcaactatttatctttgtttttattgaatttgcttgcgggttcttggtcatgaaatctaggccaatgtctagaagcatttttccaatgttatcttctagaatgtttatagtttcaggtctcagatttaagtctttaatccttcttgagttgatttatgtataagacgagagatgaggatccagtttcattctcctacatgtggcttgccaattatcccagtactatttgttgaatagggtgtccttttcccactttatgtttttgtttgctttgtcgaagatcatttggctgttaagtatttgggtttatttctgggttctcttctctgttccattggtctatgtgcctatttttataccagtaccacaccgttttggtgactatgtccttgtaatatagtgtgaaatcaggtagtgtgatgcctccagatttgttctttttgcttagtcttgttttggctatacgggctcttttttggttccatatgaattttagaattgttttttctaattctgtaaagaatgatagtggtattttgattgggattgcattgaatttgtagattgcttttggcagtgtggtcattttcacaatattgattctacccatccatgaacatggcaagtatttccatttgtttgtgtcatctgtgatttctttcagcagtgttttgtagttttccttgtagaggtcttttgactccttggttaggtatattcctaagtattttaaatttttttgcagccatcgtaaagtggattgcgttttttatttgattcttagcttggtcactgttggtgtgtagcagaactactgatttgtgtacattaatcttgtacccagaaactttgctgaattcttttatccattctaggagctttctggaggagtctctagggttttcaaggaaaacaatcatattgttagtaaacagtgacagttttacttcctctttatcaatttagatgccctttatttctttttcttgtctagttgctctggctaggacttccagtgctatgtgaagaggagtggtgagagtgggcatccttgttttgttccagttttcagagggaatgctttcaacttttccccattcagtattatgttggctgtgggtttttcatagatggcttttattacattgagggatgagagttttaaccataaaaggatgctggattttgtcagatgctttttctgcatctattgaggttatcatgtgatttttatttttaattctatttatgtggtatatcacatttattgacttgcatatgttaaaccatccctgcatccctggtatgaaacttacttgatcatggtgggttatctttttgatatgttgttggatttggttagctagtattttgttaaggattttagcatctatgtttatcaaggatattggtctgtagttttcttttttggttatgtcctttcctggttttggtattagggtgatgctggctgcatagaataaattagggagggtttcttctttctctatcttgtggaatagcatcaaaagataggtaccaattcttctttgaatgtctggtagaattctgctgtgaatccatctggtcctggacatttttttgttggtaatttttaaattaccatttcaatctccctgcttgttgttggtctgttcagggtatctaattcttcctgatttaagccaagaggattgtattttttcaggaatttatccatctgttctaggttttctagtttatgtgcataaaggtgttcacagtagccttaaatgatctttcgtatttcagtggtgtcagttataatacctcctgtttcgtttcttaatgaggttatttggattttctctcttcttttcttggttaattttgctaatggtctatcagttgtatttatcttttcaaagaaccagctttttgtttcatttatcttttgtattatttctttttgtttcaatttcatttagttctgctctgatcttggttatttcctttcttttactgggtttggttttggtttgttcttgtttctctagttccttgagatgtgaccttagaatgttagtttgtactttttcagtctttctgatgtaggcatttagggctatgaactttcctcttagcaccacctttactgtatcccagaggttttgataggttgtgtcattattgtcgttcagttcaaagaatttttaaatttccatcttaattttgtttttgactcaatgcccattccagagcagcctatttaatttcaatgtatttgcaaggttttgaagattcctttttgagttgatttccacttttattccactgtggtctgagaggtgcttgatataatttcaattttcctaaatttattgaggctcattttatggcctattgtatggcctatgttttagaaagtcccatgcactcttgaatagaatgtgtgtattctacagttgttggatgaaatgttctgtatatatctgttaagaccatttgttccaaggtaaactttaaatccattgtttctttgttgactttctgtcttgatgacctgtctagtgctgtcagtggagtattgaagttccccactattattgtgttgctgtctatcacatttcttaggtctattagtaattgttttataaatttggaagctccagtgttaggtgcatatatgtttaggattgtgatattttcctgttggacaaggtattttaccattatataatgtccctctttgtctcttttaactgctgttactttaaagtttttgttttgtctgatataagaatagttatccctgttcacttttggtgtccatttgcataaaatgcctttttccacccctttactttaagtttatgtgagtccttacgtattaggtgagtctcctgaaggcagcagagagttgattggtgagttcttatccattctgcagttctgtatcttttaagcaaagcatttaggccatttatattcaatgtttagtattgagatgtgaggtaccgttgcattcatcatgctatttgttgcctgcgtaccttggttttgttttttgtttttttttctttttaacttatacttttgttttctaggtcctgtgtgatttatgctttaaagaggttctgttttgatgcgtttccaggatttgtttcaagatttagagctccttttagcaattcttatagtggtggtttggtactggcaaactctctcagcatttgtttgtctgagaaagatggtatgtttcctttatatatgatgcttagtttcgctggatacaaaattcttgaatgataattgttttgtttaaagaggctgaagataggaccccaatcccttctagtttgtagggtttctgctgagaaatctgctgttaatctgataggttttcctttgtaggttacctggtgcttctgtctcacatctcttaagattctttccttcatcttaactttagataacttgatgacagtgtgcctaggtgatgatattgttgtgatgaacttcccaggtgttctttgtgcttcttgtatttagatgtctagttctctagcaaggccagggaagttttcctcgatttttcccccaaatatgttttccatacttttagatttctcttcttcctcaggaataccgattattcttaggtttggtcatttaatataaccccagacttcttagaggctttgttcatattttcttattctttattatttgtcatggttggattggtttaatttgaaggccttgtctttgaacttcaaatttctttcttctacttgttcatttctattgctgagactttccagagcattttgcatttctgtgtgtccagtgtttcctgaattttttattatttgtttctttatgtatttccttgaatatttctcccttcactttttttggacttccttgcattgggctttgcctttctctggtgcctccctgattagcttaataactaacctcctgaaccctttttcaggtaaatcggggatttcttcttggtttggatccattgctggtgaactagtgtgatttttgggggtgtttaagagcctgttttgtcatattaccagagttggttttctggttccctttcatttgggtaggcgctgtcagagggaaggtctagggctgaaggctgttgtccagattcttttgtcccacagggagttctcttgatgtagtactctccacatttccctgttgatgtggattcctgtgagccgaactacactgattgttgtccctcttctgggtctagccacccagcaagtccacccagctccagtctggtactgggggttgtctgcagagtcctgtgatgaaatggactctgtcagggttctcagctttggtggtttaatgctctatttttgtgcgggttggccttctgctgggaggtggcactttccagggagcatcagctgtggtagtatggagaggaaccaatggtgggtggggccctagaactcccaagattatatgccctttgtcttcagctaccagggtgagtagggcaggaccatcaggtgggggcagggctaggcatgtccgagctcaggctctccttcgatgggtcttgctgtggctgctgtgggggacggagatgaggttcccaggtcaagaaggattgtggctgcctcttctgcatcatgaaggttgtcagagaagtgggagaaaactggcagtcacagggcttaaccagctcccatgcaaaccaaagggcaggtctcactcccaccatgcccccgctaacagccccaagttggtttgcaggcagtgggtgagccaggcttgagaacttgccccaggctacctgtctcccagctgcgaaagaaaaaggtttggttcttccccagcctgtggagtctgcacactggattcccgctctcccttgaattttggctaggaggcttcttgcccctttcaagttgttacaaaattcagctggagatttccttctgcctgtggtatttttcccccgctcctctggccaccctcctgatggatccctgtggtgccaggcaggaatggcctgcttgaagacccagcgagctcccggggcttttcccactgcttcctctatccctgtatttcactcagctcttgaaattgactcagctccagataaggtcggaaacttttctgccacaaacagaccttcagtttctccagtcgggggtgtgtgtttgggagaggaggatctccctttcccacttctgcagttggggcactcagtatttgggatgtctcctgggtcctgcaggagcactctgcctccttcagagggtctgtgggtcctcttgggattgctggttcattcttgcagttgatctggagctaaaattcaccatgcgagcctctgcacgctgctctgtctgtccaagtgggaactgcagtctagtcctgcctcccattcctctgtgatgatcaaatttatgacttttaatccatagtcacatgtcagaataagtgcatggtatatggtttattacatcagttgacatgtgagtatgtaacattgaatttgtccacagcacacctcactcacattaattttaattctatgttcaataaaaatgtgtgaattatattaatgaataaatcactgctaaatattgcatacttcagtccactgcctgtcagtgtcttaaagtatttgttaatatgcactggtgaaagttgctttcaccctcataggcttggacacttacaagctagatgtgttagtttaggcaattactttttttttaatactttaagttctagggtacatgtgcacaacgtgcaggtttgttacatatgtatacatgtgccatgttggtgtgctgcacctattaacttgtcatttacaggaggtgtatctcctaatgctacccctccccccaccccacgacaggccccagtgtgtgatgttccccttcctgtgcctaagtgttctcattgttcaattcccacctatgagtgagaacatgcagtgcttggttttttatccttgcgatagtttgctgagaatgatggtttccagcttcatccatctccccacttaaactcccaagcttcaggttcttgtttgtgaaatggagattaaaagatttagataataatttatatcaaacatttagcacactttttgacacataagaattgctcataaatgttagctatcattacaattctggaaggtatatttatgtatcatgttctaaagagtcaatcagaaagctttaaaataataaatctccatttttataggcagtgctttgagttacattataaaaagcaaaagaagtttcattataaaaaccaacagaagttattataatggggaaagataaaaattgtcatgaaatgagttatcaagcaatatgagtacagatgtttcagattttaatgatgaatactagtaattgtcatttagattttaatgatgaatactagtaattgtcatttaaattttttaagtagaaatattgatacatttttaatatgcatctcatcttaatataaattggtgaaccaaattcttccctggataaatgtgctgtactaattttgaaataaaattgtttggtcacaacatagacccaatctgaatattgcagtggaaaaaaaaactgtcaaagaaagttacaagaagttatttccttactgagaaagagcatggagttgtgaaaagaagttgagtgaaatctcaggtctctgatctgcaactatatatatgatataaaaagaactttcttcatatgcaccaggaaatgacttctaaaataatgtcattgaggggggaaaaaagacctgttacttctttgttcatttaatgtagtttccctctaatacacctagagtgaggcatgaaagctcatcccaagtgtgattctgtttgcacaggtagatcaacagatgcagtgttttccaacgctacctaggtgattctgataccagtggggcctgggagccatcatctacaaggtgctttcatccacctccattgttttccatacacacatgcacaggttgtcattgtaaacacttaccatctctggagtcccttcagaaaatcttcgaaatgtaatgtccacaatccctccctgttttaaatgcatgtggtggaggcagccacattgaactagaactatcttggagttcactccacagagaccaggatagatgcaaagagcccagaatatatgccatggaagcctccacactgcctatgcagaagtacatataaattcattctgatgtcatcttagacctaaggctgggatcataataaattttaaacttcaaaatattaaataatataatttcaatatttaataaatgtctattttttaaatattaatattttctattttaaactattataagtatttatatatttactatttatatatttattaaatatatttaaatttattataaatacataatactgaatgtttatattattataaataaaatatatttataaaatacatttgaacattaaaattcttgcccatcttaacattttttaagatgttaagcaaccttgttttttaatggagggcttaagtttgggggctcatattccaatcatccttgaaacattatatttttttagagcaattaacataataaaattctgctaggagaatgcttcctttcaatgctgcatcagatatactctgatcttggaaataagctgagagaaaacaggcatcaagtttgcatttagaaaggtgaataaggccaggcgcggtggctcatgcctggaatcccagcactttgggaggccgagcaggcagatcacgaggtcaggagatccagaccatcctggccaacatggtgaaaccccagctctactaaaaatacaaaaattagctggacgtggtggtgtacacctgtaatcctagctactcgggaggttgaggcagcagaatcatctgaaccggggagtcagaggttgcagtgagccgggatcatgccactgcactccagcctggcaacagagagagactctgtctcaaaaaaaaaaaaaaaaaaaagaaaaaaagaaaagaaaggtgaataagcacagagtgatcatcaagattctaatatataaatcttagtttaaaaccagtcttgccttgaaaaagttattacaactttttaatgaaaacacaaatgagaaggaatcaaagatccttcatttgaagactgagatttccattttaaggttacatgtcaaaaaatgcatgaagtttcttcaagcactgactgttgataccttgcagacactgagccactttgagcatacactcacagcaccaaaggaaactttccacatgaattatttcttcttcttcagcatgaagttgaacttttaaagaagactttaatatgaattagttgtattttgaaattaaatatcgatttataccaatttttcatttgatgaattttttcataagtagctttatatgaggatgcttattacattggttaaaaaaaacttcagattttgttcactgtatcagaataatttaactaagtcagaacaatttaaaagttatattgacttatctcacaatatattatttcccaggtttggttggaagatcttcaagaatacatcactggggcaggggcgggggtatggttaatggatacaaaaaaaattagaaagaatgaataagacctatttgattgcacaacagggtgactatagtcaataataacataattgtacatcttaagtaactataagagtgtaattggattgtttgtttgtaacacaaagcgtaaatgcttgggagaatggataccgcattctccctgatgtgattattacacattgcgtacctgtgtgaaaatatctcatgtaccccacaaatatatatgcctactatgcacccactaaagttaacattagaaaattttaaaattataaaaagaaataaaaagaatacatcaatgataaaaatatcagaattattttattatatttatctctattgaagcactatgtgtgagctaagcatggaccagccaagcctggatcgcctaagtcctttgagatgcacgggatctattctactaaatccaaacaagagagagtaaatactttcagggcaacaaggcttgccctgcatccaaaaatgaccttataattgctaacagctgtagttcacgaacccattttccttgaggtttattttctcccttttctttccagtcttgaagtagaatttagatcttcaatatacttctgctgttatgaaaactttattaaaccttgatgttcttattaggttaaagactcacactattttacatttatccaggttttgtaggaaacctcatatttagtaacagatgctatatattattatagtattagccacttgctttaagagcccaagttctgtgatttgatttccttcctctgaatcctattctgtcacttcctagacagatggctttagcaatttgtttaactttcctgagtctccatttgctcacttaaggtagtaactaatcttttattattattattattattattattattattaatttcttttgagacagggtcttactccatctcccaggttggagtgcagtggtgcaatcacagtcactgcagcctcaacctcccaggcccaagtgatcctccctcctcagcttcccaagtagctggaactataggcatgagccaccacacctggctaattcttatcttttctagaaacggggggtctcactgtgttggacaggctggtcttaaactcctgatttctagcaatcttcccacctcatcctccaaaagtgctgggattacaagcatgagccatcatactgggtcataactaactcttaacagctgttatgaatgtgataatacttagtgtctgacacatcgtaaacaggaaataaatatcaattattaaaaacattctttgcagcaattaagttgtaaatcttttctaaagtttcactgaatcgcagaaatgttaaccaattgaatccaaaggactgaatattttagaagtgttaagagaatccaattctcagttcagaagagagtgaaatcagcacaggagtgacagactgccttactagggaagatcactgaggaagagagacaagaaaaaaagcaaaacagcagcctgaagacaggaagacaattccaggctgtacttagagtgatataaaatatggagtacaatattgaaaactttaataataggaacatgaaagagggaaagcaatactgatttaaggatggttggtagcagaacacataaaagcaaaagcagatttatattaatgccatcaaatgatagctgtctatcaagcatttaggaattgagaagttaaagaaactggtcagattattaggaaaatttccaagacaaaagtaggacctgagtttttcttcaaggtgaggtaagaattcaataaggagctattaaaatggcattcctgggagacaaagttggatgagtagcagcagagaaggcaccataccccacgtatcagacattccagtctagtgagctaggaagattcaggaaaagacaaaagataagattggcaaattcagggagaatctgtattgagaaattatcctaatacaaggagctttctgctcattctgtgggtgaagtggagccattcaatgatgtatacctgcttggctgttttgctttcaactgaagagtgatattatccaaagtgagccacttataaagcagttgcagaagttcaggcatgacttgaaaagatgcaggacttgaatagaatgaaataagaatgtaaagaaaatgcctgatgaaatagcattttctttaagaatgtcgaaatcagtgagtgagtggtgtcttaaagttttctcagttagacttgatgggatcatggtgacagcatgacaagctaaaatccatgcgtagtgttgaaactaagggaaggttaacaagaaattgtccccaagctttaaatatgcccatctaacatcacggaattactaatggccaattcaatgcctgtcttttgatgatgtggtttcaattttctctatgtctgcagggaaaaagggataaggagacaaagccaattttcttctaaaaatctacttttttgcgttttttttaagactcagacagtgctaccacaaaattaatgatttctttaccaactgcatttgcttcatttttttccccaaagccctccaggctacttctctggagagtacacaaagtttccacagcgctatttttgtaatctaaagcagttgtgctttcaggcctgatgctacaactgtaattttaatttatcaacctgccagtcagtgaaatgctgtaaaaacatgtgaaagcttaaacccatcatttatttctgcacctgtcaatgacacttttctgtacttgtcaaaatcatttaaactgcactatgatggcatatacaatatcaccagtaaattgggtaatcaatcatgtatgtgcatattttgacagtggcgtgttgaatgcatgggctcctgtatgcatttttaagaagtaggcactcattactgttcaatagtaaaatacagtagagtcatcaaaaagagtctccctcagtcttttacaattaaaaaaatgtcttaagaaacagaggggctgattgtgcctgaaatggcttttatttcttcagcaaaatgttctccttggggaaaaggaagcaattgcaggttatagcaggcagcaatatagtgttacatggagggaagaaaatgtataggatcattaaatagatttatttaagttctgcttataaagaaagcagtggtgcagtactttatagttgatgatatttcaaaagagtgttatcagcacttctaccactatctaatttgttcatataataaagtgtcacattaaacccaatatcacaattcatatcagttttacttcaaaaattggtatcatcatatatcatagggaaccctgccccaaaaaaattttgatgagatctttcatcacaataaattatagaatttaaaaaatcaatctattagagagtgagagagagagaacctgttcaatcattaaatccactcaacccagtaacaatttgatgtcatttaggctgtgtttctaagataaaatgttgttaaaattgtaacttaaatattctctaaataatctaactgtaccctctgaactcttggttgtagcaatcctcaccatttatttatttttaaaaagcaagtcttatgagaaaccctttaaaatctatgaaggatttatgaccacttcataacatgcaagtctaaattagccaaactaatttgtagacatcaaatatttctacataagaaaatgaatcagtaaacttgacatgcataagctctcactcatgggaaagaactaaccttaagtgatgtttcagaatcacatataaaacaaacaaagctttgggaggtgcattaatgtacacagccagcactgtttccttattgttaccagtactgttttcaaggaacatgaatttagttttgttttgtcttgtttttttaattttactctaagttctgggacacgtgtgctgaacatgcaggtgtgttgcataggtatacatgtgcgatgatagtttgcttcacctatcaacctgtcatctaggttttaagtcctgcatgcattaggtatttgtcctaatgctctccctcccctttccccttgccccctgacaggccctggtgtgtgatgttcccctccctgtgtccgtgtgttctcattggaacatgagttttttaaggtgtcaagccacattggaaagggtaatcatatagtcagactgttgaaagatatatttactgaatgtgtatatgaataaaatagaaatggtggctaagattagatgtcatatgtagaatcaatactgcacgaagagagttgttattgtttcaatttaaaaataagatcttagtctcatatacttttaatatcagtcctgaaaataatcactaaaaataatgcaaaataagtgctttgatttcactcggctaccttcaactcatctcaaagaaagctaattaagcttacttgaagagaactcatttctctttgttttagctccattaaatatactgaagactgaattttcaattaaataatacttgattatctaaataattttttggcagtttaaacagcatttatttcagacagttcaaagtattgactatcctttattttgtgttcttcaatgaatctttactgattctcataaagacaaaatagatatcatcattcatttaatgctgaataagtgagatacagagacatgatgatatctccataaataaacacagaatattggtagccattttggaatggagtccagtctgggacttttgcttacaaagctggcaacttcatgtatcttaacacctcatgttttcttctgagtttcatctgcacttgaatgtctaaataatagctttaattattcaggaaaataatcatgtatgtaaaaagttatttattgcttttagagctattgtgaatcccagatttgcactataaaagtgctagcaacagttttaaagcctcacttcccaatcacattctgttcatccagccaggagtgactgatctttattttatcaatctcaaaatgtgaccttttcaatgcttttaatgacattttcaaagtacagaaatgctttttgattcaaaaggattttctactttattctgcagaacaagtcagctatcatagtataatcaatagctgccaactattagcaaaagccacacatcacttatactttaagagcttatcaggaagaaaaaatgcattgagtggctatattttggcatgctaactaaggtagatattaaaatgaaaagtcaatcctcaaatgtttcatgtttttagaaatgttattatttccttagtaaaaatttcactagatcacattcaaaatataccattagaagctgctggccacattcaacttcaaaatgaaataatgtgcttgtagttttattcagtgttaggcaaccaactacagtttccccctagcttcaattaaaagcatataaaagatgaaacacttgttgagacatttcttccagatactggctaaattatcatatcatgcaagtggtatttcagttaagtgtatattatagcccaattggatactaaaagtcttgaaagcctttttaaaagtgaggttctctagagaagttattttaaagatgtgttctgtaaatcatgggcctttgattatccagcccatggcaggctaagcactccaaattcccatgtaaagccaccaagtcacaaattaagggattgcccaataaatcaaagcattcattcctaattaattttcttaagttgccaggttttcgtttgaagctcttgtgaaaggatttgatagcattgctgccctttctgtgaagaatagctgtctaatttcattaagtgcatcaattcaacatttgaagggcactgtgtatgtgcaaaatattatatgataataatgtcagttgctgttctaaactagcctgctagacagggatagtttcctactattgtgattaaaaattgagctttccttccatattacaaagataacaacaccaaatcatcattgatagggaatttagtaaaatatttagacatttattttggcaatgtaagatgaagagtagtatcaaaatcatttagacttaactaacaatatgtcttcaaaaattatgcaatgcacattgtttttaaaagcatcgttaattgcctaacagtacccgccaaactacaaatcaggggttaaaaacaggaagtagatcttatgatgccatttcattctaatcaagactttatttccagtatctttattgttatttttgaatatcaattcagttatatttagataaaatttattcagtgcaaaattccatttacgttatattggtagatgcaaagcaagatgcgaggtgcactgaactgctgcttcatctcatagtggattcagtaaagcagtgccaatcaatgaattgtttttaccatttcatttcagaaagtaggagtaagcattttaaaacgtgtagcatgtttatatgctatcgttatagcatgttatatgatatcaaaatgtatgattttgtacaaaagtatcagactgtgatagattggaaatattttaaataaaaaataaaaatttggttctttactgcaataagccaggaagccctagacaagactacatctttgcctttggggaggtagtaatctaatgaacaggacaaaacaaataatttggtgtctataatataaggcattgcttgggaattctaatctgctgaagaagataaaataaaaatgaacagacatctgtaacataagtcattccttgaagactcttgaaagagaggaaataaaaggctgcaggactagtggtacctaatggcacacaaagccaggtgggtttagtttctttttggagataggtagtagcaccatttttcttaaaagagacactggatgacgtgcctggaaaattaaacaatgactatatcaagggagactagaaagccctgaatatgttttaacttttcttcaacttccctctccctttctcacccctcccacctctgccttcttctcttactttctctctctcctccttgacacctctttattttcctctcactctccttcttttcttctctctttcctcttctcttcctttctcctcattctctccttgtcctacttcttccctctacttctttatctctctctattcctccttctttcagcttctctatattttttcttcatttaaaaaatgcatgccttctatcagaagagaatacctcaaaatattaagaggcatctgtgacaaacccactgccaacatcatattgaacagacaaaaactggaagcattccccctaacacctggaacaagacaagtatgcccactctgacactcccattcaacaaggtactagaaatgctagccagagcaatcagtcaagagaaaaaaatacaagtcatacatatgggaaaataaactatctctcttcacagatgacaagattttatacctagaatgccctaaagactccaccaaaaggctcctgcaactgatatgccacttcagtaaagtttcagcctacaaaatcagtgtacaaaaatcagtagcatttctatataccaataatgttcaatttgagaaccaaatcaagaatgtaatcccatttacaatagctgcaaaaaaaaaaataagtcagtaaacaaaggaatacatctaaccaagaaggtgagagatctctacaagaactacaaaacactgttcaaagaaatcatacatgacacaaacaaatggaaaaacattctatggctcatgaattggaaaaaatcaatatctttaaaatggccagactgcccaaagcaacctatagatccagcactattcctgtcaaactaccaacattatttttctcagaactagaaaaagctattttaaaattcaaaggaaaccaaaaaaagagcctgaatatccaaaacaatcctaagtaaaaagaacaaagccagaggcattacattacccaacttctaactacactataaggctacaataaccaaaacagcgtggtactggtacaaaaacagacaatagacccatggaacagaatggagaacctggaagtaaagccacacacctacagctatctgatctttgacaaagccaacaaaaataagcgatggggaatggacttcctattcaataaatggtgttgggatagctggctaaccatatgcagaagaatgaatctggacccctacctttcaccagatacaaaaattaactcaaattggattaaatatttaaatataagacctcaaactataagaatcttagaaaataccattctggacatcagccttcggaaagaattcatggctaagttctcaaaagcaatcacaatgaaaacaaaaattgagaagtggggcctaatgaaactcaagagcttctgcatgcaagagaaactatcaaggaagtaaacagacaacgtacagaatgggagcaaaatattcacaaactatatatctgacaaaatgctaatatccagaatctttaaggaacttaaatcatcaagcaaaaaaacaaccccattaaaaagaaggcaaaggacatgaacagacatttctcaaaagaagacatacaggctgccaacaaacatatgagtaaatggtcatcatcactaatcttcagagaaatgcagatcaaaaccacaatgaaataccatctcacagcagtcagaatggctattattaaaaaaaattaaaaaccacagatgttggcagggctgtggagaaaagggaacattcatacactgttggtgggaatgtaaattagttcaaccactgtggaaagcagtccggagatttttcaaagaacttaaaatataacgactattcaacccagcaatcccattacggggtatatatccaaaagtaaacaaaatgttctaccaaaaagacacatgcactcacatgtttatcacagcactatttacaatagcaaagacacaaccaggtgcagtggctcacacccataatcccagcaatttggaaggccgaggcaggcagatcacctgaggtcaggagttcaagcccagcctggctaacatggtgaaaccccatctctactaaaaatacaaaaattagctgggcatggtggtgcatgactgtaatcccagcttcttgggaggccgaggcaggagaaccgcttgaacccaggaagcagaggttgcagtgagtcaagattgtgccactgcactcagcctgggaaataaagcaagatccatctcaaaaaccaaaaatatagcaaagacatagcatcaacctaaatgtccatcaatagtgggctggaaaaagaaaacgtggtacacatacaccatggaatactacacagacatgaaaaataataaaattatgtcctttgcagcaacatggatgtagctggaggtcattatccaaagtgaattaatgcaggaacaaaaaaaatatattgaatgttcttactcataacaaggagctaaacattggctactcatgaacataaagatggcagcagcagaatctaggaactactagagggggaaagggagggagggcagaagtttgaaaaactgttgggtaccatgctcactaggtgatgggatcaatcatactccaaacctcatcatcatacaatgcacccaagtaacaaaactacacatgtatcccctgaatctgaaaaaaaaaaaaaaaaaaaaaaatgcatgccttcaacgaggagctttctttgctttgcaatagagctcactattggaaggaaaattaatgtatgtgaaatgtttgctgggtatcagaaataacataagttcctaatactccagcctgttctcctgctcttgctttgcagttgagaaaaaaattttaccagtagcttaatgaaaaatttaaaatactagggtataccaaaaatgtcatcattttttaatattaggccagtatgagactgctctctatttgggaattagcagtttatcatctctgaggaaattagtcatcccaaaagacaatcaaatgttgacatttgacatgcccagtaaactactaggacccttcatcatcacgctccaatgaggcccaccagtcgataagccctgcccacatgtacatctacacactcattcacacacccacccacacacatacgcccaaacacacccccacgcccccgccacacacactcacaaagctgacagccaggtttttgatgccttgccccgaaatataacctaatcaacaaggaaagaatcaccagacatttgaggaaatactctaacatggaagaaaatcccagagaaaatcagatttccacagaaataggggaaatatagagagtacaaaactaaacaaaaatactaaaaaactcataattaatgcccctagcaataggaaaatgtatctacatttaaaagtattacttaaaagaatatatgaagaacaagaaaaatcttcttagaaattaaaaaccttatagcagaaatgaaaaatttaataaaagtttgaaatatgaacttaaaagatcaaaaagataaacagatggaaaatagtaaagaaaaggtttttaaacaatcagacccttgctccaggggttcaatatcaagctaacagtgttttcacaaagagaaaacttagaggacaacattattcaatcagaatacaagaaaatatcctaaaactgaaagatacgagttttctaataaaatatgctcaccacaataaatgaaagatgacccaaactaaaacagtttactgtatataagaccttaaatgtctaaatagaggaataaaagccacatacaaagaatgagaataacatcaaatttttcaagattagaacgtgcagacaatagaagaatgcctttaaatgtcttttgatcacatgaatagacttattgtaacatggaatgctcaagattagtgccagtaaagtatctaattctgacttcaacttttaaaataattaaaatcaataaaatcaaaacaggatagttaccagaataacagtgccattataaccacattaaaaagaaaagcttccatcaaaattttatggtatgacaaatccagtacaatatattttattaaatatcgcattccactcaattttgtaatattccattttctgatgaaaatgttattcagaagagaggcttcagataaaaagaaaaattgaagtagaagtacatacgttgagatttcccaattttaccgttaaaaagtacgttagatgtcctgcaataatttgttcataagtatctttaacaaatgaataattattaatatatttcacagataagccacttggtaatttttactgacatagaactatataaacttttagtaaaacatttaaattgttttactttgaatctcctcacattttataagttagttttcatttattctgcttctttaaaaggcgtggccaggttgtttgtccataataggatcaacaaatattgaactgcactagatttgtataataactaatttatacaatttaatatgtgggaaattatacctctctgtgtatttagatatgtttatttgaaacaaaaataattaattttatgcatatgataagaaacagcctattaaatgtatatatttttaaaaataagcagcacagatagcagatacagaactctttactgtcagtactcttgactaccaagaaatgaagccacactctagaaaaatgcaatgcaagaaaagattcaagttatccctttgggtaaaaatcatccccttaataatattcttttgtaatctaaattcacagcatatcccatcagcccaaggtaatcttctaaaatgtcattatatttgcagtattataattttttttcaagccagtatttatggaggtcactgggctacggcaacaaaacattttaactccagggagagtatagctttgtaggattagctcctttgacaattgtctttctaaaaagatttttactttagaaacctctgacatatgtagttttcttcagatccaatgtatccaaatgttttgtaaaaaccaacattttgtggtagacattcaagagtaatcttataacagttcagtttcttgcttagcaaactacaagttgataacaatttgccaagctgtcttcctctgcattcactgctaacaacatctactctttctctcttagcacaggaaaggatgaatttatgtactattatcagagttgtcatggcaacactgtcaccgagtcacatcttccacaactgtaacataatgaaccacagatttctttgtatgctcaaaatgctttatacattatcaaggttgacaactccagtggcagttcgctgacccactaccttaaaaaaaaaaaaccctaggttagttatattagtccattttcatactgctatgaagaaacacccgagactgggtaatttataaagagaaagagttttaatggactcgcagttccatgtggctggggaggcctcacaatcatggcagaaggtgaaggaggaacaaggcacatcttatgtgatggcaggcaagagagcatgtgcaggagaactgtcctttataaagccatcagatctcctgggacttattcactatcatgggaatagtacaggaaaaacccactcccatgattcagttacctcccactggctccctaccatgacatgcagggattatgggagctacaactcaagatgagatttaggtggagacacagccaaaccatatcatcagtagacaaagaggccttaaaccaagccttctgggagatgtgttggtgaaataactggagcatatatagctgtattctgattccagtccacttctttaagtagacttgggtcaaacaggagtttcatgaggtttcatctttccagtaagtctgtttgataaacctgaggcaggcccactatgccccccaggacaccaggtcccactctcacttcccaacccccagcccctcctcagtgcctttaaaattttgaaggaagattatttccagccagaaggcccagaaaatcaatcaaaccaaacacactgtcaatcaagcacaaagacttttaaaagatacaggtgactcttgttatttgtggaagttatattctgtaaagtcacagcgaacactgagttagcaaatactgaaccattgctcctagcggaaatagagggctagatccctatgagcctctgatcacaacatttttgccaaccaatcaatacataaacttgctgtttgtttctgtttaaagactccatgtctttagtgtatgttatatcaatatatgatgttgattcattaacatcgaactcacagccagcagcacaactcatgcctgaaggaagctcatctaaagaagctcacatattttctctataagacacatcacagcatttcagcactatactgggggggggggggcattttaagctgcaaaatcaccaagaaaaagcacaaaagtatgaaaaatgaggcactaaatagatcataacatagatgcttatttgcagtatgaactgaaacaaagaggcagtgtcacctcattggacctcatctaggaacatgtaactcaaaatgtttaccctctatgcatgtttctgaatgatcataaaaaccctgcgagtattaattaggaggtcacaaacaaattttgcaaagttgcaaatatagaatccatgaataatgagaatcaactgtattttcagaaatataattattcacaagctatttctaagaaatctaaaggttgtttcaccaaaattatcgaactaacagaaaaaatggggggtgggggtctaacacaaaagggaaggaagtccccaaggtggctggtgaagagaagtaccaagatgacagctttgtaacagacccaaagagaaccagtctgggttgcagcaggacaatggaatgctccaggaagaatgaaaaaagtagaccattataagtgccaagtaaacaatgattgtacaagaaggaaatataatcattgcacagtatgttcctcagctgtaaataatatttatatggttatatcaatataaacattgaatattgacctaaccaaacaaaaaagaattaatgaggaaaaaaaatggaagttcacaaattcttcagtacaagtaaacagagcaatattttgagggctcaaagaggactcacttttgagtataaggtttttttctagaaactaaagaatattagataaaatgttttcttaataatattcagaaggaaagtacctctaagaaacatttatagattataataagaagagattaatatggaaaatatcagttaactctttaagacaccagatgcaatacaatgccccatttgaagcagtaaattaaagatttgatattgcagaggaaaagaaggtcaataaatgatattaaggaaaattaacaaatattccatgagaaaaatagaggaaaagtaaaatggcaaaaatgagaacaaaagaaaaaaatgggatgaaacaccattgagtttaatctgtaaataatagccattaccaaagatgacaattttatagaacatgagtcaataataaaaagtaaaatatataattcattgatttttctaaatgaggcatttagaatttgaaatgtaaagaaatctataggaatccataaatttaaaaagagactaactttaagacaaaaggtaaaatcgaactcagttttctctgtgatgtactactgtgaagataatcgtggagaatttttgtgggaaaggattgtaacacaagaactctgtgttcagctatgtcattttgtatgtgtgaagatgccggaaagacatcaacagaaaattatgatgtatcatgtaccaatcccagataaaattctagaagggtagtcactcacctggttttgtctatcctgaacaccagcatcttaaggatcaacctgttttacaaacgtatgtttaacaaatatttagtcatgttctttaactgggaactttatggaagggttaaagtgattcactgaaaatgactatgtagaaaaataatcagggaaggggaaaatttgacatttaaaaaattcagctggtaaaatagtgatgagattttttaaaaattttgaataatagtaataggagggagactatctcttctacaaattcatgatttagggataaaaattgacagtaatcagtggggaaaaaaatagaaaccataacaataagtcatgttcacacaaaaaggtcataattgacaaaaggtgcaaatcagttcttttttgcttctataatatttgtatgaaatactcattttagatagtatgtgtccagtgcagtatgagcttgtaacaaaaagacaatagaggacatgtataaatagctaggtattttgggaaaatgggcaatgcagaaaatcaagtgcatgtgcctagaggaatgacaatgtttagtataaaaagatttgctaaaatcttcaatattttaaaataataatggtgataaaaagctgtcctctcattttaatttgaatacgtttactgttttatgctgaattaatattccccacttgtttttgctacagtctattgtgtttaagtagttttcttattactattttactttgaatataagaaatgcctcttaaattttatcaaatgcctctttagtatttacagataaaatctgtaatctcttttaatttgtttttgttccagattacgttgatagatttccagacctgaaactgatactaatgacctctttctggtttactttggcttataggttgctctttttctaatgagattaggtctgagttcttttctttttcatcttttttctttaagaatgaaggcatctaaagctgtagatttttctgaggcaagtattcactgtgtctcacaggttttggaaaaagtattgtttttatttctttctagagaatatgtagtgcaatttttctttttttgacttcgcatcagtttggttggggagagtcaaagaaactgaactagtactaagggaaagtgagccagatttagggtatcagcttttgaaaatctgtaggtggatatctaaatgttacattttaacaatgtaacttaattttaatgaaattatgaaactttaacttgaaaaatatcccagaactatataatgctataatgcattaatcctcttctctaaaaagaatccccaacaaatagttttcagactcttgtggcatatgtatctgtgtgttatattacaacatacaatgttgtgtcatggtattttccattttacgattctattcttttttaaaacatactagaagctcaaggtattggtattcattatcttatttctttgttaaatttagcagtaacattcttccttataattactaccctttaatacttagtctgccttctggagccacaatgaagaaattcaattcctcttccacttgacaggctttcaaatatttaaagttaggcacccttcttctctagctgtcttctcaaaggctcttctctagcccaacatccttctctagcccaaacaaccttatttaattcaattattttttatatagggtcattgtcttgagactttttgccatcctaattttcttcatctatacggatcctagttggtcaaaattattctaaaagtgcactgacacatactaaactaaatatttccaatgatggctcaaagtgaaagtccaatggaattattaccctttttttatagacactaaaaatcatttaatgccaattaagatttcattatctggccgggtgcagtggctcatgcctgtaatcccagcactttgagaggccaaggcggctagatcatttgaggtcaggagtttgagaccagcctggccaacatgaagaaaccctgtctctactaaaaatacaaaaattagccaggtgtagtggcacacacctgtagtcccagctactcgggaggctgaggcaggagaattgcttgaacccaggaggcggaggttgcagtgagctgagattgcgccattgcactcactccagcctgggtgacagagcatgacttcgtctcaaaaaaaaaaaaaaaaagaaagaaagatttcattatctttgtggcttaatattgagattgcaattgacaaaaacactcaagtatttcttacagcaatatctgggaagccatagacaaggtagtctatgctatgaactttgattatattgatgccttggttctctcatatataaagtcaagataatattaatactaactcatagaattttgaagacaatgaaattatttgatatatgtaaagcatttagaatagtggctgataaatgctaagccttcagtaaatgataactgttaacattattataattattatcatctgttttgacatcattctccaacatttttaaaagctagtctccaccataaagagcttgtgtagttgatacattttcccttgaaggaaaactttgaaaaaatcattttaattcagtatgttaaatcataaaaatatcaactgcatgaactatgaaaaacatttacctgtaaatggacaagtgtactcttcgactacgtgtcacatatggttattctcaacaaacatggaatataaaaacacaaaacatgcaaaatacaacacagcctaaactgggttgtgtcagtcaggatctgcaaaagaatattggaatagaaagtgcttggaacagctactacctctgtggctgagggagagtactcaagggaaaaatgaagttgaagagagcctctctccccagggttgagatgcaaatctcactggaggagatgtgtttgcagctgacttgaggtcagagaagtctatgaggatgttagtggactggaggtgatgagtaggaaacctctgctgagatgcccatggttatcactgggcctctgataagctgctggtagctgtgccagagaataagaagaaaagcacctggaaaaagaagctccttcttcttctatgccttgcagttttcctccagcaccctgtactgccaaactttaacactgtgtcagcaggcaaaggaggaagtccagctccactattacaaagcaagctcaaaaaaagggtagatttagagctgaccagcaataaattgatagatggaagaaagatctaacccaatatcgcaattgtaatgctctaaacattctaatatcaatatacaggtgtttgaaaatttgaatgaaaacactttacttttctacagaaagtaaatactatagcagaaagttccacagatgtgtaacattcgatttaaaaaaatatctttgggtgactaaaacacctgccttttcagagcttatgatctagtgagatagactcataaacagccaaatacaatataatatatttagatagaagtgtgcttaagaagctgtaagaatgagacctgaacattaatgactacattgaacagttaaaacaaagagatggatcatagtctacaggattttgacatgagccatcctggaatattttaccctgaaaacttcagtgtcaagaaattctgataaattagattaagttcaaagaagagagacggtgataattaatggaagggaaagactggcttgtgaggggaaaggctaacaaaaataaatctatacaaattagctaagtgacaagagaagcagagagctgacaagcatgagttggatgtaaattcaaaaaagctataatcaaagaatagcacagaaagtggaatttagtctaattcaacaaactttataatgggggaagatgtggagcttgatttaggcctttaagaatgaacatattggctgggcacgggggctcacgcctgtaatgccagcactttggcaggccgaggtgagcggatcatctgagttcagcagttcgagaccagcctcaacatggagaaaccctgtctctactaaaaaaaaaaaaaaaaaaaaaaaatacaaaattagctgggcatggtggtgcatgcctgtaatcccagctactcgggaggctgagacaggagaattgcttgaacctgggaggcagaggttgcgatgagccaagatcgtgccattgcactccagcctgggcaacaaaagcaaaactccgtctcaaaaaaaaaaaaaaaaaaaaaatggacatacttccagcagaaagaatataccacatatgttgatggatggagagtataacaggaaaccttttgttgagccatcagttgagctaatgcaaaagattgtgtcaagatacaagaatgtctctgcctgagagcaaggagattttttttttttgcaccagagtagagccagacagagcgtaggtgctgagaaatgctgacggattaaaagagtaattgaatgaatagtgaaagaatgtcagagaaaggagctacattttggagagtgctgaatgttgaagagatctgtatgttaccttgtaagccatggggactaattgaagggttttatgctgttgctgttatttttatttaagtatgcttcctaacagacacagtagagagaaaagtaacaacataccccattcaaagtgataattccaaaatcagaaaccctgtgttactagccaaaagaaagaaaaataataggatttttcttcctccttttctcatttccaaaatttactcttcctacattctgtcactggtctatcaattaaagtaatcatcctttaaatgtgtgagacagtaaacttgactcacagcaagcaaagaatgagagctttcttaagttaggtggattattttaatctttagaacttcttagccattttctcttcctcaggtgacaggtcctgattcaccagtagcgaggaactctgtgaagatatcataattatttaggtcccattaggtttctcctcactttctcccccattacaaaggtccttgaaaataaattgaatatttcatcaatgaaacttagactaagtagcttatttcactgtttttgaattttgtatatatgtgtgcatacgtattggtgacatacaccaaagtaaaagtaaaaatttatatgtattccctaaagtgaaatgaacagatttttgttcacaatattagattggcaaagtttgtaaatttgtttaactttagatactctgacagctagaaacctacaccaacattttatgatgaattagaagaaggatcctgtagatacacctaaggatacctctgatttcaccttatccacggggaagtatgctctggaaattcagccagttagttgaattatatcctgcattatttttacattatatcttctgcattcataatttctagaactaaccatgggtattctgaagaatagctgtgccaaagagagagaataatctccataaaacatattgtccatacctgttccacatttttctaccaccagatttcttgatcatctagaaatacctaccctttgaacattcacttgtcaaatccctactctttgcaaggtccagttcaaatgccagctctttcatgaagccgtgtttgatccctgtgtctcactcaccacctcctatttcccctccttataagctctcatagaagttcttatttcagattcagttatcaaattctgcctcaacttacggtcaactgtgtatttgtctaatctcttatacttagattgaaattccttgaggttagaagtcatgttttactgataatgttattcacaactcctagtattgcacctgacttacaattaagaactcaataattgattattcaatttaatatagaaagccagttatcgcaattgagaaggctctagtagtagttattattggcaagatgtttgctaagaacacattaaaatgtttcctacttgtgctaggaaatttattagtattcttaagattatattttaatgaagttcggtgagggaaaataagaagaaatactttgggtattagcctactcatatgaaactggctttatgaattcaaagggattagataaaattgattacgtatattgtaaaacccaatgagttgtgattcttctataaatgaaaaagtttaaatgaaatttcaggaaagttacttggtcctcatttaatcttcagtaataaaagaaacagtgtggatatatggctctaagcaattactttagcaattctgattccccattacatcttgagagaatgtgaatgattaaggacacactgagaagtaggataaaattagtaaaggtgtactggatttttaaataaacaatatgaaatatttgtttgcactaaacattcaaaaccatcatttcatttttctagaaggtcaaatacctgccataagccaatggttatgcttccaagcaatagaaacctcagcatttccttggttgagtttcatcctagacagtgccctaaacttctattttattatcatttttgttttgagttacctaagaaccaaatagtcatactaaactattaaagtgagagcgacaaaagttcttctcttaaaagccaaaatagatcatcccataaggatcacagtaccactctcagtttatgagggagaaaaggggtgtggggcagggatttttcttaactgaaaaaccaactcttcttagcaatacagttctaggatatataaaattctttaaaaaactgaatatgactcctcacaatgccatcttttggtgggtgatttcaaatagaggttcactcagaaagaaaaaggggatttttatgaaagagatagaatctggaaagagagaaaaggatcccctcccccacaaaaaaggactgaggagggtggcaggaacattggggaaacaatagctagtgtgaatcagacttgccctggtgtgatctttggatctctttgaatctctttctctttcttggaaatccaccttgattttatagcttatgacctgagccaactactgccatgacatttctgctaaaagcccaaaccattaagacaaaagcagtcttgacatgattaccaagacaggtctgtttgtgcatttcattttatttttaactttgacagataaaattgagtttatgatggcaggcagtggaacctgagaatcaaacaattcagaatacttagctataactggttcttgtaaatacatcttagcagtcaggattgaacaaaaaaaagcaggttggacaagataatttaagcagcaactgagaaaaataaaaatgaattttcttttcctgtgtacttttaaattcccagaaggcttttaaattatcgaagtatttactgaaggtataagacacataagtggaaatcattactgtcatctatattaataatgcctttataattgatgagtgtgtcgtattttcttcttgcaattaaactctgctgtctgagattacagcataaaaaagagtctctgaaaaaaattataaaaacaatttgggggcggcaggtggggccaagatggccaaataggaacagctccagtctacagctcccagcatgagcaacgcagaacatgggtgatttctgcatttccaactgaggtaccaggttcatctcactggagagtgtcagaaagtgggtgcaggacagtgagtgcagcgcactgagtgtgagccaaagcagggcgaggcatcacctcccccgggaagtgcaagaggtcagggaattccctttcctagtcaaagaaaggggtgacagacggcacctggaaaatcgggtcactcccaccctaatactgcgcttttccaatggtcttagcaaacggcacatcaggagattatatcccgcacctggctcggaaggacctacgctcatggagcctcgctcattgctagcacagcagtctgagatcaaactgaaagggggcagcgaagctgggggagggatgcccgccattgcccaggcttcagtaggtaaacaaaatggccaggaagctcgaactgggtggagcccaccacagctcaaggaggcctgcctgcctctgtagactccacctctgagggcagggcacagccaaacaaaaggcagcagaatcctctgcagacttaaatgtccctgtctgacagctttgaagagagtagtggttctcccagcacgcagctggacatcggagaatggacagactgcctccttaagtgggtccctgacccccaagtagcctaactgggaggcactccccagtaggggcagactgacacctcacacggccaggtactcctctgagacaaaacttccagaggaacgatcaggcagcaacatttgctgctcaccaatatctgctgttctgcagccacgactgctgatgcccaggcaaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagtgcctctcctcctccaaaggaacgcagctcctcaccagcaacggaacaaagctggacagggaatgactttgacgagttgagagaataaggcttcagacgatcaaactactccgagctaaaggaggaagtttgaacccatggcaaagaagtaaaaaaccttgaaaaaaaaatgagacaaatggctaactagaataaccaatgcagagaagtccttaaaggacctgatggagctgaaaaccaaggcaccagaactacgtgatgaatggacaagcctcagtagccgatttgatcaactggaagaaagggtatcagtgatggaagatcaaatgaatgaaatgaagtgagaagagaagtttagagaaaaaagaaaaaagaaatgaacaaagcctccaagtaatatgggactatgtgaaaagaccaaatctacgcctgactggtgtacctgaaagtgactgggagaatggaaccaagttggaaaacactctgcaggatattatccaggagaacttccccaatctagcaaggcaggccaacattcaaattcaggaaatacagagaacgccacaaagatgctacttgagaagagcaactccaagacacataattgtcagattcaccaaatttgaaatgaaggaaaaaatgttaagggcagccagagaaaaaggtagggttacccacaaagggaagcccatcagactaacaactgatctctcggcagaaactctacaagccagaagagagtgggggccaatattcaacattcttaaagaaaagaattttcaactcagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaaccagtaccagccactgcaaaaacatgtcaaattgtaaagaccatcgagtctaggaagaaactgcatcaactaatgagcaaaataaccagctaacatcataatgacaggatcaaattcacacataacaatactaaccttaaatgtaaatgggctaaatgctccaattaaaagacacagactggcaaattggataaagagtcaagacccatcagtgtgctgtattcaggaaacccatctcacatgcagaggcacacataggctcaaaataaaagggtggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcatacagcaagtccttagagacctacaaagagacttagactccaacacaataataatgggagactttaacacaccactgtcaacattagacagatcaacgagacagaaagttaacaaggatatccaggacctgaactcagctctgcaccaagaggacctaatagacatctacagaactgtctaccccaaatcaacagaatatacattcttctcatcaccacaccacccttattccaaaattcaccacatagttggaagtaaagcactcctctgcaaatgtaaaagaacagaaattacaacaaactatctctcagaccacagtgcaatcaaactagaactcaggattaagaaactcactcaaaaccactcaactacatggaaactgaacaacctgctcctgaatgactactgggtacataatgaaatgaaagcagaaataaagacgttctttgaaaccaatgagaacaaagtcacaacataccagacctctgggacacattcaaagcagtgtgtagagggaaattcatagcactaaatgcccacaagagaaagcaggaaagatctaaaattgacaccctaacatcacaattaaaagaactagagaagcaagagcaaacacattcaaaagctagcaaaaggcaagaaataactaagatcagagcagaactgaaggaaatagagacacaaaaaacccttcaaaaaattaatgaatccaggagctggttttttgaaaagatcaacaaaattgatagactgctagcaagactaataaagaagaaaagagagaagaatcaaatagacgcaataaaaaatgataaaggggatatcaccagtgatcccacagaaatacaaactaccatcagggaatactataaacacctctacgcaaataaactagaaaatctagaagaaacggataaattcctcgacacatacaccctcccaagactaaaccaggaagaagttgaatctctgaatagaccaataacaggctctgaaattgaggcaataattaatagcttaccaaccaaaaaaagtccaggaccagacagattcacagccgaattctaccagaggtacaaggaggagctagtaccattccttctgaaactattccaatcaatagaaaaagaaggaatcctccctaactaattttatgaggcctgcatcatactgatatcaaagcctggcagagacacaacagaaaaagagaattttagaccaatatccttgatgaacatcaatgcaaaaatcctcagtaaaatactgacaaaccgaatccagcggcacatcaaaatgcttatccaccatgatcaagtgggcttcatccctgggatgcaaggctggttcaacataagcaaatcaataaacgttatccagcatataaacagaaccgatggcaaaaacctcatgattatctcaatagacacagaaaggcctttgacaaaattcaacaacccttcatgctaaaaattctcaataaattaggtattgataggatgtatctcaaaataataagagctatctataacaaacccacagccaatatcatactgaatgggcaaaaactggaagcattcccttgaaaactggcacaagacagggatgccctctctcaccactcctattcaacgtagtgttggaagttctggccagggcaatcaggcaagagaaggaaataaagggtattcaattaggaaaagaggaagtcatattgtccctgtttgcagatgacatgattgtatatctagaaaaccccactgtctcagcccaaaatctccttaagctgataggcaacttcagcaaagtctcaggatacaaaatcaatgtacaaaaatcacaagcactcttatacaccaataacagacaaacagagggccaaatcatgagtgaccgccgattcacaattgcttcaaggagaataaaatacctaggaatccaacttacaagggatatgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttacagattcaatgccatcctcatcaagctaccaatgactttcttcacagaattggaaaacactactttaaagttcatatggaaccaaaaaagagcccacattgccaagtcaatcctaagccaaaagaacaaagctggaggcatcacactacctgacttcaaactatactacaagactacagtaaccaaaacagcctggtactggtaccaaaacagtgatatagaccaatggaacagaacagagccctcagaaataatgccgcatagctacaaccatctgatctttcacaaacctgacaaaaacaagcaatggggaaaggattccctatttaataaatggtgctgggaaaactggctagccatatgtagaaagctgaaactgtatcccttctttacaccttatacaaaaattaattcaagatggattaaagacttaaatgttaaacctagaaccgtaaaaaccctaggagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatgggagaaaatttttgcaacctactcatctgataaagggttaatatccagaatctacaatgaactcaaacaaatttacaagaaaaaaacaaacaacctcatcaaaaagtgggcaaaggacctgaacagacacttctcaaaagaagacatttatgcatccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgtcagtgggactgtaaactagttcgaccattgtggaagtcagtgtggcaattcctcagggatccagaactagaaataccatttgacccagccatcccattactgggtatatacccaaaggactataaatcatgctgctataaagacacatgcacatgtatgtttattgcagcactattcacaatggcaaagacttggaaccaacccaaatgtccaacaatgatagagtggattaagaaaatgtggcacatatacagcatggaatactatgcagccataaaaataatgagttcgtgtcctttgtagggacatggatgaagctggaaaccatcattcccagcaaactatggcaaggacaaaaaaccaaacgccacatgttctcactcataggtgggaattgaacgatgagaacacatggacacaggaaggggaacatcacacaccagggcctgttgtggggtgggggaaggggggagggataccattaggagatatacctaatgttaaatgacgagttaatgggtgcagcacacccacacggcacatgtatatgtatgtaactaacctgcacgttgtgcacaagtaccctaaaacttaaagcataataaaaaaattaaaaaaaataaaaaatttagtcacgtatttcctttgtgagcttatttggttacatctgaaaatactgagaacttttattccatgaaaatgattgtcccctcaatcaatagcaattgaatgcatcaaatatgtctagcaccatttctgctacacagtaaatactcaaatatatttattggaattagcaaccattcccttttctttgcatcctctacatctgttgtttttttattttttaacaaaagccattctgaggggtgtgagattgtggttttgatttgcatttatctaatgattagtgacgatgaccatttattcatatgtttgttgtcagcttgtcttcttttaagaagtgtctgttcatgtcttttgccttctttttaatagggtgggttttttgcttgaaaatttatttaagtttcttacagattctggatattagacctttgtcagatgcacagtttatgaatatttcccccattctgcaggctgtctgtttacttccttcatagttttgctgtgcagaagttcttgagtttaattatgtcctacttgtcaatttttgattttgttgcaatagcttttgaaaacgtagccaatatcaaaaaggggatttcctaggttttcttctaagattttcatattttgaggtcttacatttaaatattcaatctatcttgagtcagtttttgtatatggtgaaaggttgtggtctagctttattcttctgcatatcagccagctatgatggcactattgactagggagtcctttccttattgcttagttttgttgaatttttcagagattagatggctgtaggtgtatgtccttatttctaggttctctatcctgttccattggtctattgtctatttttgtaccaggaccatgctttttggttaccgtagccttgtagtatagtttgaagtaggataatgtgatgcctcttgctttgttctttttgcttaggattgctttggctattcaggctcttttgttgttgttgttccctatgaattttcaatagtttcttccagttctttaaaaaatgatgttggtagttttatagggatagcattgcatctgtaaattgcatgggatagtatggccattttaatgatgctgattcttccaatccatgaacaaggagtgtttttctatattttatgttgtgatttctttgagcagtgttttgtagttctccttgtagagatctttcacctccttggttaaatcaattcctgggtattttatttttgtttgtggctattgtgaatgggattgcattcttgatttggctctcactttaaatgttattggtatatagaaatgctacctatttttgtgtattatttttctttgccagattttggtgttaggatgatgctgacttcatagagtgagttagagagaagtctctcctccttgacttttttggaatagtttcagttggattggtaacaactcttttttatttgtctggtagaattcagctgtgaatacatctgatcatgagcttttattgattggtaggttttgtattatggatcccatttcagaacttgttactggtctgttcaggttttcagtttcttcctggttcaattatgagaggttgtgtttcaaggaatttatccattttctctagatgtcctattttgtgtacatagcagtgttcataatagtttctgaggatcttttgtatttctgtgggattgattgtaatgttatctgtgtcactgatcttgtttatttatttagagagccaacttttggttttattgatcttttgtgtagattttcacatcttggtttcattcagttctgctccacttttggctatttttttcttctgctaacttcggggttaatttgctcttgtttttctaattcccccatatactgtattagactgttaatttgggagttttctaatttcttcgtctaccagtttagtggaaagtcttgggagatgggcacctgtggccatgtcttgctgccgctgccccctacacaaaatcccttgggctctgcccagacaggagctccacctctgcctattttctgagcagattcccctgccaattcaaatgtctgtggggatcatggcatctcttatagctaggatcccagaggtctgtggcgaaagtggtttgccccacagtcacttcactcagccttccttaatagccattcagggctgggaattagtcctggcacttggcatccccatgcagggtccccagcttcctccatcttcagcctcagttactgtgtcacctctctgttgactctcagtgttttctctcaaaagatctgctttaagtatgtaggtttagtccacattttggtgtctcttggtgagacaggcactttctggctgcatctagttagccctcttgttctgatctcctgaggtgacatttacaccttagggtttgatggtagccaataggtgggctttagcatccctcaactcaatgtcacagttgtatctatactattagaataaactaaagcaaaaaccattattattttaataatccatgactgccagacaaaagtggctatttccttcttacactttaggcagtggtctcattgtccccttggtttgcatagatggatacagcattgctctagccatacaatgctcagtcttccattcagatgctcaaatggagtaagttcttactttatatttcagcacctgaacccaaacaccatgtgttccatttgacagaactggaggcagactttaccttcatggattaggtctgctcttagatcaggatttttcaccctctatgtaagagcatgaggagctataaataaatctatccttaaagccaaaataacaagcccatcttaataaggttatttcagttaacataagaatagttacaaagtaaaggtctgttaaatttatttggaaatataaaattattcctccattatatagtagtttctcaaaacgttaaacatagaattaccatatgaccgagcaattccacttctaggtatatacctaaaagagatgaaatcagggaatcagacacttttgcaccagtgctcatagaaacactattcataatggccaagatgtggaaacagccaagtgtctatcaacagatgaatgggtaaagaaaaagtgatatgtatgtcagtatacatatatatctataggggtgatatagataatatttacatatattttaataatattctattggagtaatacttttaaatattttgtgtgtgtgtgtgcatatatatatgtgtgtgtatatatatatgtgtgtgtgtgtatatatatatatatgtatatatctcatcccaatggaatattgttcatcctcaaaaaggaatgaaattctgatacatactacatggataaactttgaaaatattatgctaagtaaaataagccaaacacaaaagaacaaatattgtatgactatatgattgtatgatttgtatttgtattaatgacagaggctggagaggcaggaatgggaagttattgtttaatgagtataaagtttctgtttaggttgatgataaggttattgaaatgggtagtggcaatgtttgtacaattttgtgaatgtacttaacgccattgaatcataaactttaaaaagattagaatagtaaatatggagttatgtatgttttgccacaataaaaagaaaacgagtaagtaaacttttttttttaaattactcccctgtggtacagttactccattcatcatcacattaagacttcttccaggttggggagtgttgcgagatgttgtcaaaatgaccccacttgtgaaatcagaaaactttcccttaaatctcagctctgtcacctagtaggaatgcaaatttgagcaagtcacttaggtctgttgcaccttaatttcttcaggttatgctgtccaacagagttgttttgatgactgtaattgaaatgcatataaagtgcttcgtaaattcaaacaacaaggcaagtggatggaggtgactttttaaaatatattcttttagggagcttagtcgtaatactgttatctctgaaatgcatttactaattcatatttaaatatactaaaatattaaggtattgttggtaagacagccacagttatttttctaatttttctctatttaaagtattgaatccatagttttagaattaaaaaatcctgaatttccaaggaaccacatttctattcaccatttctataatgaatgggttattaaacctttccatttatcttatttcaataccttttgttcattatgtagcctcattgtacataccttaggaagaagggataattatattacctcagagagaagggacaactatatgattatcttgtctgagatgaaaaactatggtcttcattcatacctaattaaaagttttttgtttttgtttttttttttttgagacggagtctcgctctgtgtcgcccaggctggagtgcagtggcgcgatcttggctcactgcaagctccgcctcccgggttcatgccattctcctgcctcagcctcccgtgtagctgggactacaggcgcccgaaaagttttaacttatttattttgctacctgttctgattttcattccaaaccacaccattatcagtccctacattgtcaaacatgtaataataatttggcatgacattatatcaaattggacattatcttggaaggtcctttggatgcataattatattgaaaaataaatattttaaaagtaacaaattttatgctataacatcataagttaataataaaattaatgtcattgaaacaaatgccaactaatttttttgtttccctctttagcggttatgtctttgactatgattactacagagatgatttctacaatcggtatgtgaatttttcatccttgttttcctatgacttaaattatcttttaaccattttgtacattttattcatgggtgctcttaattatggtatttaaaacaatattattatagttaaaaataaaatactaaatcccaacaaaatatacagatttttatattttcattatacttacttgagtacagtggatcttggaattttaggactttggaggtgctcaaacctaagatttggtgtctaatatttagataaaatcctaaagatttaattaactaatattatctgccaagtcatttgttgatttagaatccttcaagatcaagagtttgaaaactcagaaaaataactccaaccttctgaagtccataataaaacattgaaaatgctatattgggtagagtctgtaaaatttacagatcgttcctgctttgcaggacagtaggaggccacaaaggtgatgatgcaagatgagaccatccaatgaggaaaaaacaggattgtctcatgatcttaaacatgtttgtcaaaacattaacaacttttattctcttctctataaactaatgggaaactatagtaaagctaattgttatttagtatactataatttaaaacaataaaatattaagaattaaggtgttttagttctttgtaaagaacacttatcaaaagtagttgaaacagtgcatgccttctcatttcctaactcaggacaggatacggagtaggcatctgttttatcccttgttggatactcctctctaaggttgaattagctttgacattctatcaatgttgtgaactatctctgagagttctttcaatgtgtgattctcttgccagggtcacttcccctccatagcgttatacgtttcatcacatcacatccactttcctcacttatgtcgataagtttgcctttactaagttcctctgactccatacctagagtctcttgagtagaggagtatcaatatccctataatgagctatttcttctgtaatttcatttacatttaatttgagtttcacatctagtattatcactcttcgattctttgctgcattttcatctttgatcaattctttcttttgattattcaattttgcaaaatgccacgttttgtcactgagagataaggaagcattacaattaatgatctgaaacaagtgagtgaagtgaataatcaatgaacagcaaaaaaaatcattgacagactttgaaagatggaatgtgattagtgatcattgttattatcatgcacatttattatttatgcatttatttgtggaaaagctagaagcaaagtttggactttattaaattacttaccgtttatatgttgtagtaactaaaatttgtgttgtcggagaactggtgttatttaactaatatcagtaactgaaatttatgcatatcagagatgaggatcaactatatatagatagattacgggattaaaaaatgaggtaaatatattttaagcctttaattatgagtattatgcaaacaacaaaaaaaaccttaggtactgtataaaaatgcaaacttagaaaaaatttttcaatagatgttttaaagaggaagtaactgtgatccttgaaagggtcttattctctctgctccagcctctagggccttttgtaagttccacaagaattccatgtttcttcctgcctcaggtcctttctctgtgttgttccatctcctcatacctccctacactacctggttcacttgactcctcatctttcagatctcagcacgaacatccctcacagattaaattaggttcctctgttcctctcgctcagcgcccagcactgttacttcacagcacctctcctaatttctattgctatatttctttctgcagtgtttgattcatgtctgtcttccttcccccacctgaacaatgttcagttttgcttatctttgtatccttggggactatcagtaaacctcacacatagtggatactctgtattattaattcatctccttagatttagagacacagtcattttccgaaggtcaccaagctaattagtgacagaactatgatcataatctaggcatccaatttagattcaataaccaactatgtgaatatgcacaatggggagggcaatatcagcctatggagctatgcgattcctacttgagaatcagacccacaactgtaacttcattgctgcaatggtcaaactactgaattaagcaacttatttcactagttatccttttctgacaaaaaaatataatctttaagaatgattttctcaaagcattttataatttctataaaatatattttaaatattaagaaacttatcataacttattctaaaagtgatgcaaacatctggcagcattaaaataatcccatttactattaaggaaggatatctagactgtttttatactatttgaaaatgttactttttgacaagtttaaagacattttctactatagctattttttcacttgctacgaataaagttttcaattaatatacattgtcttatactctgtctatataaaaccattttagcatcttttattttctatcatatgacttccttatacatttaaagaatttccacctaacatggagttttactctacaccgtaggagacccaagttctggttgttaccggaaaggggtcccaattcagaccccaagagagggttcttgggtcttgcaagaagtaagtcagggcaagtccacagcacaaaagcaagtttattaagaaagaaaggtggtgaaactatagctactccatagacagagcagagtattcccagtattcccaaaagtaagaggaaggacgtgcctgccctaggtacaatgcttgtttatacataggacaacaacaacaacaacaaaaaccatggggagttgtgctctactacaagggtttgtgataaaggatacatttttctaattactgcattttgcaagaatcaatatgactatctttaaagcaaaattaggaatgcttttgttctgaagatatggagatatcaagacattcctgggcctgagtctgtttagtaaacattattaatctgttctcttaaccataaacatctaggagctaggaataaatacctaacctcctgggaatgcagcccagcaagtcccagcctcattcttcctagccctcactcaagatggagtcgctctggtttgaatgcctctgacatggtaactagccttgtaactttaggcaagtcaggttttcagttttctcatctttaaaaggaagccaggatttgcattttactatttagaaatgttagctcaataaaatcattagattagataggtgatagatggatggatggagatagatcgacagatagatagatagataatcaatagatccatcttacttgccaaagaacaagagctttaaatagtcaaattattagagaggctgtagctttcaggtgactctctactatacaagaacttagctacagtatgaacaattttcaaaatcatttatttgttttgtgtacaatctgtttggcatggaagtatgaaatagatcagtatggttgtattgttaacagactgagcagtctgtgctctcgttagtttattttccatttttggcacttggctaagaaagacataagcatctgccactagtggatatactcaagagttccctataaacatagaataccatgaaataaaaacagaatggagaggctggacaagatacatagcttacagagtcactactaatccacagtcatttctcataagttacggtcttcttgcatttgtgttttctttttctctctctcttttagcagaggtgcaaacttgggcaagttagttaatatcacaaaatctgttatgtcctctgggaggtgagcatgaaattaattcctaactcatgaaatcattctaagaattaaatgaggtaacataatgatcagcattatgcctggtattttttagtgcttaatcaatattagctagtattaacagttaacagtaaccattaacaataatggggccaggcgcggtggctcacgcctgatcccagcactttgggaggccgaggcagacggatcacctgcagtggggagtttgagaccagcctggccaacatggtaaaaccccatctctactaaaaatacaaaaattagccaggtctggtggtgggcgcctgtaataccagctactcaggaggctgaggcaggagaattgcttgaacccaggaggcagaggttgcagtgagccgagatcgtgccactgcactccagcctggggacagagcgaaactccgtctaaaaaaaagaaaaagaaaaaggaagaaaaagaaaaaaaaataatggtagatgtatttctcatattgacattcatacagcagtgtccatataactgagaaacaaactggttggtcagtttttcttccattatagctgatttgggacatctctggattattctgttttcccagttttccctctcctactcccccaaagcattccggctgcagctgatcacacttgcctgcagagagcgctcagctgtttctgttaaccccatgctgcttgtttagatcatgaaaacagaaattacactacttacgtataacagggctaattgcatatagaaactcgttaagtcggtattaaagaactgaaaacgcaaaaagacaacactgtgatatactggagttagtgactgcaggaagctgctaccacttctagggctggagaaacaaaggaagatttggggtctcagaaattgctgtagaaaaagagcctaccagagctgaaactatgcataggagattctgttcagatggtgctgctgtgtctgagtccacaaggagaacctgtggtgctgacacccaaatctctgagatggggatatgggctgacaggtgctggggtctttgagggagcgtggagtggctgttctccaagtgttgcaaaattactcagactggattctgctgatgctactggaatgaattgttgttgccaggatgaagaaactagattggggtaatgctgaaaagagcaggaagccaaaacacaaataaaaagcaaaacaagaaggagcaggtcccttttccttgctccaaccttgcagtctctttcttaggtcctttattggctgagcccagcagggagctagctgcccaaccccaaccctaaccctcacctccggaagtgtggttttcagagttccaaacccatcatctgtggctaagggtaggtctgaaaccaagaaacaatagcttaataactaacatatgtccacattatattgtcatactctttctgccaggtttggagactctaatgtgattgagggtttccaacccttagatagttttagcttagaaaacttctttacacaatgttccaccttactgtgattcattgacctgtctattcgtggtttcagggatcatgaagagtatcattaaacagtagatgagtggttattctaaattcttatcttttctcttttacacaaagcattgcccaataatttacagcattgaatggcattttcttttaaaggtccatatatgactctaaatgtaggacattgtatgttaatacattaaacgtaagtatttatactctagcaaagtaaaaggagatgtatacctaaaattatatttaatctccctagggaaagtttttaacttctgcaatgttagctgtctaaatccaacctcttttttcaataatattaggaaaagcactgatcagtttataatttccagtgataaggagacttttattaacagagaaaaacaaatgccacaggtgttttacttctatgtaaaacacgtatacattttaaatgatccaaaataggcattgttcaattctggaaccattttgactttgtgttaattgatccaagaaactactagatttgcagttaacgcaagaacactaagttacagttgtttcagatagttgattagagagcacaatatatattcatgaatattggaaaacatattaacaagaaacaatgttttgttatgcaaatttgaactatcctctggtagtatggtattccatttgaaatgtttgaaaataacagcatggtacacttgacaaatggtattatttggagtcagaagacatgaatttcaggactagatgcacatgtgttgactggttaagcttggataagtcatctcttttttgtgccagtttccttcctgggcaaaatggcttcacactactgaccttacagaattacaagaattaaatgagaaaatcgttttagtggcttataaccccacaacaacatttgaatttattaactttttaattacacaaagctgtatacaaaatgtacagttagcaatgttagataaaatacagactgtattagaatcaaaatattgcaaaaaagatcattcaagattgcaatcaacttgcctttaaaagcatgttcaagaagtatttccgtgtgatccaaggagaaaacttcacagaaaaccttggaaaatttaataacaaaaaagatcaatggaatttactcatttactggtctcaggtagagtgtgccttttaaaattattttctgattcaactgtaaccaaagatttatttgaagtcagagtagaaattataggcagagtttatgagttttgagtagtttaaacagtacagggaacagatacactaccagcctataagaattatttgtgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaaaagaattatttgtgtagatttcaaatctatcccttcttagaaatgaataggcaccttactttggttttatatactgtacatctgtcaaagttaagcataatgaaaaggaaggctggaggttgaatcaagacatggagcaagatcttctctggtcctctggttattgatctttgtagagctactgaaaggtgctggtgagaatatggccctgaatttgttatcaggttttgcctctgggtagcccagaaattttagccccctagggaagaccaaatatttttgttagcatcaactacttagtaactataagttttgattcatgaacaaggaaaaagaagaattgttttcatgagggcaatttagaaagaaacaggtaaataccagaaaatgtttgaagttactactaatctaaaatgaaaatttaatattcagtaataaaatacaacacacatattacatttttcagtttcttttcttgtgttttaaaccacgtttgttgacagtaaaatataagcatcaagtcagaagtttagccatcaggtaatgatttattagaatgtggtgtatctacctgagaaaatgccccacagccattaaaataaacattacgaagaccatttaacaggcctgagaaatgtttgtttttaatataaaccaaagagaatgagctagaatacatgactgtacatatattatgttttcaattatgtgaaaaatatggatgcttataaaaacagattaaagaattatagtagttgttctggggtctgagacttagaattgtagtttttttatgtacttttttttcccaaaatgttactttattattgctaaagcttaataataacaagttcttttttaaaaaagacacttaaaataatgtttgctttgttaatatgcctttgtccaaaaggcacttagtttttaaattaaattacctttgtccaaaaacaattattgtttaagaacagtagatgaaatcaaatgtccttattcttcctagagaaaagttgtctattttatcaaataaactactattaaaattaatattaccagtttttagcttttgctagctaataaagttacatatgtcagatattatttaaagcattaaaaggcaaaataagaaaagggtacatagaaaatagaaatgtttattaaataaagaaattaaattctcaaattttctccatgagttggttttattaaaattggactgaattttttaaatttattacttgacagcaggtgttttagagttttcactgtaaaatggaccttgaggaaagaattattattatatgtttggcttcattataaaccattatctatttgatgagtaagtatttgggagaaaattatcctgaccaagaaatattagggaaaattaagggctattaaaggaaaggagtggaaatataaatccaaagggtaaggaacaagaaaaacaagaggaaggaaaaaaattaaagcttttcactagcctggagatttagattccatttaattctgctggattgccatttctgctgtcagtctacaatcttaaatgaactagttccttagtctcaatactatttgccaatctaatatttgataaaggtaaaatttctttgatttactgtaggccgaattctgatgagaaggccaatacctgtctttcttgggctgcctttcacctacttccctctatattttgaagaacccctatatcccatcttgcaatcgcagaaagccttccccgctttctatccttgtcttgttatgtttttgtacattaggacaacatccagtcttccctccttttatttctaattgactcaagagtgcccaatgaaaattaagaaagtcttcaggtccattaaaagttgtaaaattaaaaattatgccctcgtgttagcccatgttactggtggaggatgtccaggttcttgaacaaataattgggcaaaacgcacaaacaaaggaaggaaagaatgaagtaacaaaagcagaggtttgtggaaaatgaaagtatactccacagggtgggagccaaccgagcataagggctcaagagcctggtgacagaattttctggggtttaaatactctctacaggtttcccattggttgcttggcatacaccctatgtatattaagtagtggcccacaatcagtccgattggttgcgggaggggaccaatcagaggtactttcaatttttcatcggccatgcagaaaaaggtggcaggatgaggaggggcgcaaagggagtagcctctggtccttttgttacttgggcgtagaaaggtggggttttcctttttatttagttctaggaagtcagcatgaaacagccttaggttccctgcctccagaccctattctcctgcctcacgcattcccaattttgttttgtgaatgacctatcacattaaaatatttaagtcctgatgctgcccaacgtcccatcaaagtggaagaaagaattggtaaaacgttacccaataccttggtgaaagtcatccagccaggcttggtggctcatgcgtataatcccattattttaggagcccaagttgggcagatcacttcagtccaagagttcgagaccaggctgggcaatatggcaaaatgctatctctacaaaaaatacaaaaaaatttatccaggcacggtggcatgcagtagtcccagctacttgggaggctgaggtgggagaattgcttgagcccaggaggcagaggttgcagtgaggtcacaccactggtctccagcctgggtgacagagtgacactctgtctcaaaaaaacaagagagagagaaagaaaattagtcattttcctttgaagtaactcaccaaaatattcagagaacaggccactcaccataggaatttataccaaaggaaagttgtttagtaaagtactaagtatattactaaaatgtatgccccatactaaaagcatatcataaatacagtgagcaagtatggctctttctcagcataagatcaggccatgccactgttggaggtttggtaatccttggctgggggaagcaatagaaatattgataaacatttttgtttcctataaaagtagtattaaattacattgcaattaaagtagcagtgaatatagtgaactttacttggcctgtatttttactatagcactcttacatcattgtatattttgattgtgttttagagattttcttaacccaatttatagattggcttgtttagtgaacctgtaaaactacacattggtgtcctagggaaatggtcctgctaaaagagcttgcctttcatttcaagcagcaacttctactctagaagagatcagtcaattgccatattttcttttcactcaatagttttgggtgttatagctcatgcaaagtgcctttgtattttggttcactgacttaaggtgctctgtgaattcaacttataaataactaatgtagatcttgttttgtgattgaaatgaggggcaggtctagctgacccttttgattctcaagcccctagtggtatggatgatattcataacccttttcagcctcatcctgcctgtgctctttgaagtaaactattatgtgttgacatccatgacctgttctttgctagctgttcttcagctctaatggactttgcttagtcacagaagatggcacctctcttgaactctgtctcatttcatttcttttcctttccagatatctcttagttttttccccagcatgttctaaatcattttcgaataccctaagtctctaatgtaggagatattcttaatactaaggaattttgctttaaatttggtttaatagtgctttttgcgcttccctcacctcacagtataatagttttaaatgtctctaaatgaatatttggaaaccagtctatcttaacttttattatatttcatatattatttcctaaaaatagatgatcacattttcatctgtatgtataaacaagatgtaattttatgaattaacctattatagaacttgttttttttattttcttcccattctagtttctcatttctgactttcatattagattgtttttattgactgttttaaagtaattataagaatgtaatccaatattttattctgtcacaataaaatatgtaacaatcataattctaagtcaataatgctattttctttatagtgaataacgtaattacatgtctagttcactggaaaatagtcatgaaaatgaggaaatgtatcccagtattttttcattgaccttttaggttactcaaatgtgctgtcatataaaaatctgttgtatatgtggatgcagtacaaataatatgaagcttctgaatctatgaattatatatttttataaatgagttaacccttataccttgattcctttcattgtttaatggaaattaattgattgtggtgaatatcatttttcacttttccgcaaaggttttaagttttattgatttttttgttaaatatgcttgtaatatctaactataaaatatctctagtctcaatttgcaaatctaacaaatggtcagaataattaaaagatatcttgataaatatttcccaccgtaagtagtcaacagttttatcctcacgctagcttcatgtcattcaaactgtctccttttgtctgcaatcagaggagactttgttactgaaaagattcttaaagtgagctgaagcaccatattgatttgtctgtcatagctgttttcttgaagctggttttactttttatcttgctgggctgtttactgtttgaacagtaattttatttctttgttcctgttctgcaagatcttttcctcttttaaactaatgtgctaataagtgtttgatgtgtaagaggaatatttctgttcataagaagtgtaaatctgttttaccaagcaaagaaatatatttaggaatgaaggtcagcataatttcaacaaattgcatggtactgttggagcaaagctccttgtcctttcataccttacaaatgagttcctcttggaggtcacactctaaagtccagaaagcatagactatattagcatctattttcttagtgaaaattaaatctgccaataaatacctgcatctgaatattagagaacagcagcagaaagaaaacatttattgaaattttctaccaggacattctgttcaacatttcacatatttgatagaactctcgggcatcaaaccaactctcagtcccatttgtgttttgtaaaggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaatgtaagtaatgtccttcattttatttctctttaaagaagggagtgattaactatcattgcacgaatgcctatattcaataaattaaccagatagttatgaaggacctgctatgtataaagtgttagaaaatcataagatggataaaaaatggtctctgctttccaccatactgtgttgcagtaggggagacaaacacaaaaatgtctaacaaaaatccaggaccaatttgaaaagtattttatcagagcaaataacactgtgctcttggcttagcttgtgatatattaaagtactgaaatataatatgttgcttttaatgaagaaataattttacttccaaagggagtgcataaactgtcttttcagagaaacatacaaaattagttcatggtttgaatatttgagcaattaagagaggcaaactatagagatgttaaaagcataatttaccatacagtgataaattatgataagatatatgtatctgaagatatatttaatgtcataaaaagtaaaataatatttgcatagtttcacattaattagtaaaaagcagcgatacaaactttccaactaaacacattgctaaatttttatatggagtgatacagaaaaaaattttatttgttagaatattattcataaagaaaggataacaaaatttcccatattccttgagattgccttttatcagaaaacaaacagataataagctgacctataggtaaaagaataaacacatagagaaagttgagaacactatatttcattgactgaggtgacatttgagtggaaacctaaaggaagtgaggaaaagagaaagtgaccttgaaactgtcagagacagagcattctgtggagagaaaatggtcagtgcagagaccttaaattgaatagtcaaggaacaataaggaagccagtgtggctgcaacagagccgagccagagagagaaagtctggctggggatcaggtcagagagttagacacagggcaagttccaatgcagcttggtaagccgccgtagagacttggatttactctgcatcccaaccatttaagacaagtaaggcaaatactattatcccagttttattgatgagtaaacacagaaagtcatatagctaatagacatagtagagtctcttagttcttatgcctatgtgctatctgctgtagaacactgccttttatttcagcactatactgagatagaatcactattgaaacactttgtttttacaaaatgcagttcaaaatgcaggaaggtactgatgcttctgaaaaggctaaagtttgttgtactcaacaaactttgtggacctaactaagataacttcaatagcacactaaatagatttatggatttctatgtaattatgtattcatgtatctattctgtagatagataaatatgaattccattttgagtcttagtaataaaagaaaaggagtttctgcaactcgttggaggttaggtcaccccaatgtggagtatacacaagtttctatctctcaaaaagtctccaagtgttgaaaatttcaatgacttatttcttacattggaaaaaataaaccatgaagggacttttatagaaagacaaattaccaaagtcagctacttggagaaataatgtgaagagactttacagtttgtaaccattacaacatgtaacataagaatctatccttaagtccaatggtaaatcacacatgaggtttaatttcatcttttctttgtgtgtgtgtttgtgtgtgtgtgtgtgtgtaagatgcgacagtcttgaaaaaaggctaaatctgaaaattggactactaaatacaaactagagatattttgaaagaaatgtggtgtgttttattttttagcagcaatcattctttggaactgtgtatcctagagtatctctgttatgctggaaagatatagataagcaataggtagaaatataaattatgggataaaaagattttgtaaggacaatcaagacaaatgatcatttaaaatctattcagcatgttataattgtgttaattttacttacttttgtgaagtggtgtatctttattatattgaggttaaatcaaaaggaaatgtttcatataaagcactggggaaaatcactttaaaagatttatcctaaggattaaatctaagcttggaggtagaatagtcatgtggtttccagcatcaataagatagctccaagggattactgcagagagacaggcaagccataggctataggtgcaaccccagtaagatacttgagtcagggagcttggcaggcctggtttacatggtagaaaacaggggcccctgggcctgctccaagccagccctgcagcagagcttctgtgtagtagtcaatgtcatggtcagtcacatcccagagagtacccagaaacaaggggcagccagccatgatgtacttgagcatgatgccagccccctgttattatagaaagacaacagactgatctattctattcatttcatatagttctataaatttagagctcaagtcacaaaagctaactgttgattagtgttactttagtgaaacattaataaaaatttataattcactggcaagcataactagaatcatgatttaatattctttttaggagcatattggcagattacattatgtatacatatatgtaaataaaatatatatgtgcatgtataaatattcattaatttatagtactttttataattaggttggtttctggaaataacaaaagtttctaactcaaatcacaaatgaaaagtatcagtgaaatttaaaatatactatgttaatattgaaataatttgaataaagatttactaaggtatatagcttgctctttaattaatagctctttccagcatttaatggtttggcaagttcagaagaggaaattaatgttatagcttggataatttgtcatttcttatttcagaatttgtaatatgactgaattctgctaaggagaaaactatataaagaaaatatattaatgtcataatttaccaaaaatgaatactgataagcatttaaaatgaactgctttaaatagattgccactaggcatttctgtcccttttaaaatcaaattgaactaaaactataatcagcttgtcctttcctgacatcatagagtcataaaataaagaaaatgtgacattgcagattagcattttacaaaagagaaaacatgaatatcagtgagctttagctgtagtttcttagtggaaaaattgatgccctctggaaaaaaaaattcgatcaagtcaatttctttaaagaattaatttaaattctaatgtctaacaagaaagactctagtaagtttgaatgcctttggggacctgtcaatgcactttcagtgacagaataggtgacaaactaatataaatgccctgaagcatctaacaggaaattaaagacaattcaattaaagttaaaattgagaatttatccccaatgctaagaaggctttcttatgttgggttcctcccctcaaaagtatgattgaaatacagcgataaagcatcaaccagagaaataatattaatactcagcaacatatcattaaacattcccatccatccattatcctaggcaaagtatattctgctttagagatttttaaagagagaatgtactattggccggaaaggttagagaaggcttaacagaggattttgaactgagtttagatgagccagtagattctgaaagatagaatgagagatacttgctttctgggagacaagatctgggtggagaagaacagaggctttcctgtcagattgcctggagtggagtctgttccatagtatactaccatcgtggccttggggaaatcctttaacccctatatacctctaatttctacctggaaattgaaaataatatactgtgtatccaatagttattgtaagaattgaattacttatgtatataaaatgcttaggcacatagtaatgttcaatgaggttaattattgctactactataattattatagcagttaagagtattaaatatgaaattgctgaacctagaatccaatagtgcctcagccatttattatgtgtgttttgcagcaaggtacttgcttgctgtgccttagtttcctcatctataaaatgggaatgataatcttactgccttctctgtagagttctgaggattgaatgagccagcacatgtagagctcttagaacagtgtcggctaatataaaagccttaatagataatactgtgacagtaaaaataataactattattatctgaagtgaagatttactgctaggaatgtcagttaataaactgaggacattattattaaacaagatataaaaatgggtaaaaggataatgaaaaactgtgcagagtattgaagggttcagatttcatgcagggccaagataaaaaaattctcagcaaagtgctacctgctcaaaatgatattttaggacatctatatgatgggtggcattagttggcgagggctgccataacaaagtaccacagttcgggtggcttaaacaacagaaatttattttatcacaatgatggaggctgaaagttggagatcaaagtgtcagaaggcttggttccttctgatggctgtgaggtaaggatctgtgtcagtcctctctccttgactggtagatgaccatcttctccccatgtcttcacactgttttctctctttgtgtgtcttgtctaataaatttcctcttgttataaggacaagtttagacccctctatgttacaagggcatcacctgtcctctaacttcaggccagttgttcgtttttttattatgggacttacacttttctgcttcatgttatagttatttgtatgcacatctaatctttctattttcaattacaaattcattcaagttaattatgctttgcacagattatactcttaaacatttgtgaaatgtgacatcactactatttttgctttttgcattttactttttgtcatacattttatatttgactttgaaccaaatctttagaaatgctacagttcagagaaaattagttacagaatatgttgcatcagtcggtgaaacaaggggacaaattctggcctacactccagggtctaaaagaaatcagtatgacgtgtattttcaagctatgtgatttgagatctgctacttctgttacttagaagactgtttttgcttgctgaaatctaaagtatcttttcagtcataactcaaaaactcattcttttgtgactattttcacaatcagttatcatcaaaactaatttatcttttttctttgcccacatagctgatacaagttcaattaatcagcacctaacacagacaggtactaattttccattgacgaaatagacatgagccctgaggaactatttcatagacaaaatagacatgatctttcattttcaggcacttatatctggtcgggggcaggggggaccagaaaatttaaaaatgtgagataatttcaatatcaggtgacagaacatttttactatttctcttttttttgtattttatatgcataataataaattagttacatgtttcttgtctgtcactagttatagagtccatgagaccagggaggcagttcaccatgatgggcagtggggggtaggagggtgggacctatatacccatggctttggagtcaggcagcccactctaaacttgaattgttgcctattggctaaagcaatctttttaaagaacacttaaaaaatttttttagaaatagagtatcactctgtcacccaggctggaatgcagtggcatgtaacctcaaactcctgcactcaagctatcctcccacctcagcctcctgaagaaccaggaatacaggtgcataccaccatgcctggctaatttccttattttttgtggagttagggatctcagcatgttgcccaggctgatcgtaaactcctggctcaagcaactctcctgcctcagcctcctaaagcactgggattagaggctgaacaactatgcccagcctgctaagcaatcttaattaaacacattacttaacttctctaatattcactattcaaatccaaaagtaagtttaacaattctgatttgcatattgggaataaattaaatgatacacttgcagcttctaatgaaatgcaagatgaacagatgcatatagtaggcatttaatgaatacttactgaataaaatccactcattctccatttcattttctttctaaaaaatatagaaagaatgggtatagatgtatgtaggcataagtattatgaatacatatatatgcatatatatgtaattccctgttctaggaaatttcatctatggggtgggtgataaccagttgctgcaatttattttagcaaaatactttaaagtttgacttttgaaaactattttctagactagcaaattagccttttcatattaaattagcttcaaaaattgtattatgtattatgttacaagggtatcacctgtcctataacttcaggccagttgttcattttcttattataggatatttatatatatatataaagaaagggacagatgggagcagagcggaggcgttgaagtgatcatgataaagagttccaggaaccttccttttctttttctgaatattattgaattaagcacagtgattccttgatcatatttttcacatcaactgaagctgcatggcacaataaaaaatatagaattgaaagtaagaaaatctaggtttgagcctaaactcttacctgtgcatatcacatgactttgggaaaatcatgtacatcatcagattctcagattctttattgttgaaatactgtatttaaaactgatttataaattaagtgatatgcaaattttatttatttctttgttttggacattcaaataatgtataatggctggggaaaataaataacaaattaatgtgatttactgtcaaagtccacatgattataaacatttttcagttttctaaatagttgataggaagcatggtattggtaagggaggttatatctagagcagggtttcaatagtttggcatgatcggcatttggggtcagataattctgtgatgcggtgtgggctatcttgtgcactgtaggatgttgagcagactaaatcctcactagaagccagtaggaccaccccctccaagtcataacaaggaaaaatgtctccagacacagcagaatctctcctgcagagcaaaatcaccatgttaagaaccacggatctagacagttagctgaaacttctttatttaccctgaatagacttgacccaaagatgattaaaataaattgaaatatttttggccacataagtcagaaatgcacagatttttatatagacagatgatatcatcccgtgtgcctaatattctttttggattatatcttatgtcacagcagaaggcacaatcattttgtcaactgtatcagaatgtaataacatttatcaccaaatcaatgaactctatagagagagcagatctgaaatgacttaatgtgacttatttttaaaaacaaagatactacagtgatagtgatgcaacctgacttctatttctctagtgttcttcttgcctaaaaataagctaaagtaatttgtcctaggaactttgtaatttttttaatttatcattttgctgatttttgtttggtaattctaaattcaagccctataatcactcatagaaaaataagttgtcctcaacaagacaaccagagatttttattatgacagtatgtttgcttttgtgtataatttttttttttttttgagtcagagtctcactttgtcacccaggctggtgtgcagtggtgcgatcttggctcggtgcaatctctgtctcctgggttcaagcaattctctgcctcagcctcccaagtagctgggattacaggtgcgtgccaccatgcccagctaatttttgtatttttagtagagacggggttttaccatgtttgtgtataatttttgacaagttttttttgtggtaaaatttatctagagaaaaagagcaaaagatatttttcctgtgaagatagtattaccaatgtcttctaaaatatctgtaatgtatatatatatatatatatatatgctcaactactagagaatagtaagcaaaaatagggatttaatataattcactgtgcaggagagaagttgttaacaggaggggaaaaagtagaaaacaaaagcagaagagagctagaaagagcagtacatgagagatagaggaggttcatcccaggcattccatctagaaaccacatgtaatagcacaaaaccgtaccccatatatagatagtgactctgcatgaagaaaagtagaaagtggactaaggccaattggactaggtaaggggcaagccttttcccaaggacagcactgagatattgaagtgtgatgaggaaacgacttctacaactgctcaagaggcagccaagactatttgtagagcctgctttgcaggacctagatgagcatttgctgcccccccattctaagagggaactgagcagcctgcatagggttagaggctcactttaacatttcctggtagggtccaggaaagaactgacaggatttccgtgttacatttcaacattgtttcttgagtaacattaacttattagacccaaattccataataatccagctgagatctgaaagatgttctttcagtgctagacctgagtctagacttaaatgaaaccttggctccctggagacttctaagttccagccagatgagtctatattgttttctaatgtagtttcaataaagtggagtagtagtggtttattggcttgttttttaaggcaatacataaattaaaattagtcaactgcattcctgggctaaggagtagctctagttgctaagaaatatattctgttagttttcagctatagtcctatttatttctcctgcattgaaatctaatgttataagataaaatattttctattaaatttgatacgtttaagtaaaactacatatgccttcatcaaaggaatgagtaccactcttcaaagcaaaatcaatttgcaattgtgacagatgatgtttttcaaatttagctgcaattccacaatggtactttgatgtctttgaagtaattgacatgaggagtgattctctattttaccctgttctactttcagtttagtcattcctcagagggatactctagagggcccatgcttcttgcagtttttattttgcaaactactttgcattgtaaataaaagtctgctttaaaaaaaatctgatttgacaatgggaaaagttttctcatttttatacaaaaatctgttcttcccttaagatttagtgtttatgatccataacatatcatgtatattatatcatttatcttaatcgacaaatagttctattttaagcaaacataaattgcattttgtttttgtttttttattttttcaaaaaagtctgaagactaaagaatcaagttaaacactctaatttcctcagaaatttctggggaatatctagtctgagattattagaaaccagaaggaaaagagacagaagataaatagactggaaacaaataagtatccaagatcttgaaacttggctcttgaatgaggtgtgaatactgccagtccacctaataaaagctcggaggcagatatagctgttccattgtaatggctttaaaatctttcatctctgattgttgtggattcaaaatatttctaaattccattatccatttgcatacccttcagtcaaaagatttaggattaaatgctcgtgtcactgagaatccccatttgtaactggcataatcattcagtattccaggatcactagaagtaatgagaagttgataaaattgaaatggttttcagaaaaataaggacagtgcagtaaattttttacaaatataaacatatttcatttaaagaattgtcttcgaaatatgagattgttctttccttaagcctttttcccttataaaataattactgtagtcaatagtaggctatttattgttgtttttaacatccatacttggcaaaatgaaaaattgtcatcttatgttagtccccagttgttttctttgaaactgtactaaactctaaaaatctagaatgggaactactactattgaaattatcagtgagaacttctgtgattttcctttccatcaagcccagggcttagagggaggcatgtacaactcactgccttagttttatttaggaaaactgaagcttcatagcagctttgagtgagctggaaagagttttctcacatctaagacattttctttaaaggataaattgtatatcctggtttccatcaatcttcaaggagctggattaaaatatcattgactgctgaaatacatattacaacatagttcctcaaagtagtatctggcatgatttaattattgcttcatctgaatccctctcacattgaagatttactctattttgtaaaatttagcatcattgggttattttaaaaaatatttcttaattccgttatccatttccataaccttcagtcaaaagatttaggattaaacgctcatgtcactgagaatccgtatttgtaattggcaaaatcatccagtattccaggatcactagaagtaatgtgaagttgataaaattgaaaaatgtcctatgtgatttgacacagacttgagaaaatacggggtccctgtgagttcggtcctaggtgagttatggtgcatttgatgctctgttgttttcttccttctttctactttccagtgaaatcagatgagttacagaccatcaagaaagaattaacccagatcaaaactaaaattgactccttgctagggcgcctggagaagattgagaaacagcagaaggcggaggcaggtaagtgatctctgatcacagacaggtcagaattgaaccagtgaaacgttgtcaatcacagaagcagtacagggccaggaagacactggctgagtttaacagtgtttaatacagatgtgccaacaatgtctttaagcccagagttgcaataataaaatgtgattttttttcttttagagaacatgaactaatttttctaaggttcatactaaaaataaaaggcaaggacaagtgttttggtggaataatcagtagtagttgagtcacagttgaaactttatctcaatatcaagtaacctttcagaaaataaaatcaattaacagaataatgctatcaggctaacataatattcatatataattaaattaactgcagcaaaatttgacaggtttcaacaattattataatgcccaactcctgcctttgctgccaccctgaaagacttcagtacccaagttcaggaacatcaagactaagaccatgcacctggctacccacaggccaagttatttgatcatatattttacaatttaatagcctctgtcttttgaattatcagccctgacccagctcctttctagtaccagtctaatgctcttttcatatggctacagatattttttgagtcacaagtatatgagacctggtataaacttagaagtaggccacagtttgaaaagtgtgctctatgaggctttagacgcctcagaagcctccttggagttaagatggggattaggaagagacccggtaggtagacagacttatgcctcttcgaatcccagcccttcctctgaccagtgtaacttccctgtatctgttctagatactggcattcaacataagacttaatttgctggaagagttccatttcttataaaataaataaataaataaagtgtgaaagcccttgataaatccaacctcttcattttgcagatgagaaaacaaaggctcaggaaagtaaatcgattttcctagacctgtatatctaattagtgatagacctcggtctcaaactcagggcttgtaactgaatttagtgccctttcccatttacagccccaatctcaggttctcctcagagctttgtcccaggatttcactaaagtaaggctatctgggtgacacctaaatgatgagaactcatggggacctagggcccctgagctaccacacacaggagcctgtcagtttgttgactcatatcactggggtgagggttggagcgtacccttggcagtgagccatacagggctcaagaatgaaaagaagcacatgtgaggtggtagtgtagcataatggatgagagaaataaactctggttcaaatcgctgtataccacattcacagttttctcatttataaaatgatactgatggctgcctcacatggtgagtaatgaacaaagtggcatatgtaaactatatagcacagagttaaaaatataataattggagttatcaaggactagtagcaacacacccatgtacaggcaaatggacatttcctccgactttcatacggctcatttttaaaaaacataagccatgtacctagcacatggtcaactcacactaacccttgttaaggtagatgaggaatgatagactaaatggaatctttcttaattaaagatttctattacaaatgtattatttccaattcagaaaggcatacttgcctatactttttaataaaaaaaatagattttagaaagtttttaacatgctgtctatggcactgaaatgttactgtaactgaaatattctgtcatgttgcctaaatcaatatttccctttgaggaactctgtaaaattcattattatgtaaaacaacccttacagcaaaggactttgataaccaatttgcacttcagtttaaaggattatggagaactcatttaaatatggagaactcatttaaatataaatcacctcaaagagaaaaatgtggtccttattccatcataatatacctttcagtttgctgcaatgactaataccttccatatatctttttggaagatcatttagaaatgtaacactaaaattcaaagcttgcatctttttttcatgagatgtcacttacttttgaacatgtttaaacttttacagtcatgagacagttgcttttaaaataataagacttagtcctttgatatttatgtctctttaactttttatgaagaaaatgaatttgtaactccattcttttagtaattgtttcctgaatagtgtatttatagaaataaaagataaatgttttatatattttactatattttcttcacgaaaaaaatcaggtttgcttggaaagaattaacactaccttatggaaagtagagtgaaatgcactaaaactcattttaaaatgctcagtggctccttattcaaggggacagtcattacaatgcttaattagttgaaagctaattacttacttggtagctagcatttactcttcattattactctttcataaatttctcactcctaatttactattagttatttatttaatagtgaaattttccagcagagaaataatggcaggaaggagatggagaatctgaaagtgtggggaaggacacacaacatgggctgtgcctgaggtcaagttccatagtatcttttttttggaagcgaactcctaagctctcagtacattactttggattttctataccttaaattgctcaaatagatgtgtgtgtggtgtcctgtcatttgagattgttaagttcctcagaacaagatcatgtcttctcttccctaactctacccaacaccaggtattatgtactgggcacaacttagcaagtcatttaactctcttaggtctcaagtctttcaaatgtaaactagaggaatgggttatggcctcaaatgtatattctggcttctaaaactatgattactgtgaatccaccatgcatgtattattttttccattacatcacacaacttctttggggatatagtgactatgtagattatagaaaaccacaagtaacacttaaaatcagttcggccagcaattttgcctcattgttagatgattcttttaaaagagccgcatataagttgccacatatgcatagcacaaattacatgctttacgcaaagatgttaagtgaacaaaaacagtgaaaagcacaagaaggaaaagtaaaaagactggatagcatgcaatgggaacagttactccatgggtaactacattttttaaaaaattacatttcaagtgcagactttctgaagtgaaaaggcaattattagacattatttagttcaattttattctcactgttattcctgatacatgagcagccaagtctgactgggacaattccagtgataacattgggatgttagacttacgtcttagagaggttacaagcaggagtcccacaagataaattcatcctacccatatgtttggtataagagatgaagttttcaaaaataaattaatgtccaaaaattggagtattgtaaacaaatctcaaaatatgagctcttttgaaaatattgaacttttcaatactgctactcaatcactctacacatggcatgcacttttcagtttgctaatatctttatccagccagttcatgtatttatattatctatttggtccctgttcacattcatgtctgagactcccattgcaggttttccttacactgagctaaaatgtattttgctttcacttggttcagttatcactcttatgttctctgaaaagaaacttaatgtctaattctttgtgatacaacagtcaattaagaatttaaagggagtggccggccgcggtggctcacacctgtaatcctagcactttgggaggctgaggcaagtggatcacttgaggttaggagttcgagaccagcctggccaacatggtgaaaccctgtctctacgaaaaatacaaaaattagccggatgtggtggcacatgcctgtaatcccagctactcaggagtctgaggcaggagaattgcttgaacccaggaggtggaagttgcagtgaactgagatcacgccactgcacttcaacctgggcgacagcgagattccatctcaaaacaaataaatatatatatatatatatacacatatacgcacacacatatatatttaaagggagctatagtattctcacccctccaaaacctttgaacagagagttgatatcattggcctatgggtattcatcttaactgcattcaaattttgatcacagcatcgtagaggcctttttggtctagagaaatatcaacagttcctttagttgcttctcatttaacttggttttgcaccttaaactattgccatctctcttctctagtcattatgtagtttgtcaacacagattacgttgctcagaatggaaagtgttgctccagatatgatctgactgctgtagcctataacatgactaccatttctgttctgaataccttactgctctcattgacacttcagattgaattggtgatgcttccggttaaagatgatgaattaaacacatgaattgagcagtgttttctcttgaagctgcattaaaaacaaggaaagggtttagcagctggacaggaggtatacctaatttagcacatcctagaaatccaagtccaattttaatcacaaactcccaaaaagctcagaattcaaggcatcatattcccctggaaaataaatggttgaaagtctgtttaggaaacagattcctatgtcccagctatcccaactgcactttgaaagaaggctggagaagtttcctctagtgaaggtaaaacagtgggtctcagggctggtagacaataaggaaacttgagagcacttaaaagcagagagggagaaagtttccgtaattactgtagaaatgcccaccttctccctgactcagctaccacagcactggcaggacactagaagagtcttcagttgagaacatgagcagcccaagaggaaagacttaaagatgctgatagagggtcaactaaggaatcactcagccagaccacctacagagacagtatctctctatacttacaaagttgccagtcaatattttaatgccctactgttaatgtgaacaaacaagaatcaccagatcaaagaacatagttaataagcaaatgccaaaaaaaaaagaagtcagaggaaacaaacatatacaggaagaataaaacttcaaaaagaaaaaaaaaacactaataccctcagagaaatgagaagatactgtaataaaaacataaaattatagaactgagtattcaaagcgctgataaaagagcttttataaattaacatatgatagcacaaataaataactcaatacaatgattggaagacaaaattggaaaaactctcccagaaaatatggaaaaaaaaacagaaatggaaaataggggaaggatatgagaattacacgatgaatatctgaataagctttagtttcagttttcctaggtcatctgtattcattctgagttgggtttcagtttacctatgtgggaacccaaggcacgggaaccatctcagcctaatggccttccaattaactgttttaatatgccctttctctgaaaagtactaaaaagagtacttcaccaaaaacacagcgataaaccaagaaagaggaaaaacagagccttcctaaagcatggactctaaaagcaaaaaacaaaaggaattctcaagatagaggtaacagagatcctaggagatgagctgtgcaagagatctggaaagaaatgagtccagatcagaactgctcaaaagctctgggatagactttttaagacatcaaaattgatgaaatagctactgggtgggaaagaggattggttgagaaggaggggtaagtttgcataagtacgtaaagagaagcacatagagaacgaatttttaaaacttgaggcaatttttaattctagagaaaataaaatattcttcaggaaagaaaaagtattcatcctgtactaacaacttagctgcacaaagtactttcaccataaaaattgtgtaaaaactgaaaatttattaaatccaatttacaatatgattctctagagagatgggaagtgaatggggattataggaccaagaactgaatcctcagcttcctagggataatgtcaacagatagtgcataaaactgatcgagaagtagcaatataaacaatatttagagataggagtgcatgtatttaaaagattcagccaagtgagtggaaagcctttaaggagctggaaatggtgaacaggtaggaacaaaacgctgctgttttccatagcaagcttgtagaaatatttgagtacaaaaattaaatattttaaagaagttaaatataagggggtgaaaagacattgagttgtccttagcaactagatcaaacctttcaactgcttactggagtgcttcctgtagtgcttcctcagttaactgtaaaggcaagattgccctggacacttactaaaagcagcaaggaaggctttgttcaagactattgcaataggagataaaattgaactcaactctgcaaaaataaaaggcagaataattttttgaattctagaatgagctaaaggcaggcagattcttgaatgctggagcaagctaatggaaaagtattgggggatgttggaggaggatatttggccaccatctgtgtttgctaattagctcttattaaagttaggctgctactctcccaaggagactggaagacaatggctctatcttattcaatgataacatgtcaaagagatagctcctgaatcttaagaaaaatattcctgggttacagaaaatttgcctctcaaatgggcagagaaagaatttacaattgcaagtttgctaaagcaaacactctaaggaaaggatgctccagggcctatggtcaggaagaaacctacctgtagtttagtcaagccaaggggaatattgaagccatcttgtgaataactcaatcacagtctttcaaaattgaattctttctcctcactttcctacctagatatactcctctgtaccctatctctgtcatcactattacataaatcctgtccatcaaattgccagtctcaacattatcctctattcctaccatagcagtgttgccaaatcttaccttgggtatatttttcaccccttccctctattttcctaaagatacgccaatacccaaaccctcatcatctctcacatgttctgttgcattcatcttattttttacaccaatttattgaggtacagtttacatagaataaaatttactcatttcaagagtacaattcaatgacttagtgattttaccaagtgatacaaccatcaccacaaatcagttaggacattttcatccccctaaaaatcaccttttagttggtctccacttctggtttgcttcctcccgaattcaccttccttgtggaaaacagatttacattatctaaggtcccagacaggaataaaacaaaactaggttcacatcccactagagacctagtttaacttactagctgaatgaaatttggaaaagtccttataaaacctattaaatggttttataaggattatataatatctctactaaaaccattattagatttaaataaacacaattatataccagtaatttttaaatgatttatgttgcatttgtgtcatctcaacaatctagggtatttcatgtgaacaactttgaagccatttcctccaaaaatgtactcacataactaatatattcatctaaaacattctatgtaattttcctgatgttcatttatgtggctgatagtaataccatccaaaataagttgtatttttctaaatggaatttattggaaccattgagttaaattaatactatatacaggtgttgtaatataaaatttttcttaaaatacagtttatgcttgtatgcaaaaacaatgattcaaggatactaacttggctctagtgaataatgtgactgtttttgtatcaacattctttccaaccatctgctaagtacaattcagctagcaattatctagcaattaagccagcatgtcaaaaaacttaattgccaactcaaccaattttcatagttatattaatgataatagctatgcagcaaactcaatttaataaaaacactttgaacataaatcccaacaattctaacttgttttctgaatcgtagatagctttttgaagtagagatgagatgtgcagaaaaaatatttgaatatgaggattggaatttaatattaaattcttttctttcatggttttttaaagctttaggcattttcccttaaacagaaatacttacctgtaatttgtacttcttttcctttgatagtcattgtttagctaactagaacatgtgcccctaactaaacagacttcttcattcttgaacttaaaattggttattgaagagatttgaagtattcccttggtatgtcaaattaggccttctttttttagagatatattagaaaacagccaaggttataagatcagaaatttaaacttggaattccagctcttgcacttattactgtgtgaccatgagcacttatttgtgcctcagtttccccatgtgtaaaatgataaataagcctacattgcagtatatttcaaggactaaagttaatgaatcttacatggtcagcacttcataagcacacactaacttgtagccattataaaccgtttctttttgtaatccataatgtaggtgtcttagaggtgtctttttacataagctgttggctttttggcttctaatcgacctttaaaaaaaatctaatactcatttctcttttcacaaaagaaatgctatggtcatccatcactctgacttaaagaagccaacagacactccaaaagatgccagtgttcgaaggcagccctcctccaataagcactggaagacttcacatttcatttttctcttgaagacttgtcaatataaacacaaacaattttcttcccagaaaatttcagacctcacattttactttgactttgtggtttgggattgtcatgtagaatgtggcaacgaggtttttcagttttgtttctttttaagttatcttggatttatatttttgttaccatggtgtgcaaaattcaactgtcactttaactgaaaagaatttgacacatttgatatttattttaattagttgattccacaattcattaatatattcagcaaacacttaacttgtgattaagggtctgagttagccaccaggtaaacaaagatgaataataaaaatgtttctgacccaaagaagctttagcagcagagagagaaatgcacatacacacaaacacacatacacactcacacaatcacattgacagtaaaaagagtgatgactagaagaataactatgcaaataaagagaattgtataaagaacgaactaaacgttactcatctccaagaaaagtaaaattagataattattcataaaaaaagaacaagttgctttatctctacttcagcaatgtaattactgaatcaaaactgcctattaaactgtgaaccaacagtttaataaagaagatgtgctttcatgtgtgattttattcatggaacctatcattgtttagtgattataatatttcccattgagatgatgacaaaagctatgttgactacctattactaacacacaggctgattgtatttgttaaactcctgtgactcaataccattataattaaagcttttttttccctcaactcagataatgacttccaagcatttagctttcaagttaatgattggatgatgagaataatatataggattttttgcaatgaactgtattaatataccactgcctttgaaatacatcgtcagaatcacatgtatattgtatgttaatacaaaaaatagagtaactatgtctatgtactatatactgtattagtttgttctcatgctgctaataaagacatacccaagactgggtaacttaaaaagaaaaagaggtttaatgaactcacagttccatgtggctggggaggcctcacagtcatagcagaaagtgaaaggcacatcttatatggcagcaggcaagagagaatgagagccaggagaaacgggaaaccccttataaaaccatcagatcttgtgagacttatttactataatgggggaaaccacccccatcattcaattatctcccactgggttcttccaacaacacatgggtattatgggagctacaattcaagatgagatttgggtggggacacagacaaaccatatcagtactggactatgcctgtctaaacatagaactaaaaaggctgtgttgaaaccaaaacccaagataatctttataatgcctgattcttaatgatcagtaggggcgaataattttgacatgggaaatttgtctatagcaatcaagaaataaatatagattcaactcaagaactgttttgagcctgttataacatgtttgtgtggtctttgcagtttaaaaaacacagtcacatctttttcttcgttagagcacacagcaactctgaaatagatgttattttcatgcttaccttttagagaagaaaattacaattaataggactagtaattagcagaagtatggatctcaaaccctatatccttcctgataccttatctcttcatgtgcaaggcattcagtgaggggtacggagcacatcaaaatgttttgataactgacttgaattgtgcctttcagtttactaaagatcgacctctgtatcatcctttttgagtgtgacaacgatcttctgaggcaatagctcaactttccaggaagcttaaacactaatgagaagaagatgagaaaacagtagaactaactataagacagcatttgatcagggccttggttgatcaaagagggaaagattacattcagctgggaagatcaggaaagtcagctttcctgatacaagctgaaacaaattgatacatgaagccagatgaggactatgcatgtttaaagtgtggtcctacaggggtcctttgaaaatctgctatgcttccttggccagagatcttctagagaaaaaattatatatacatatacacacaaacacacacacacatatacacacacatatatgtatatatattacacacacacacatatgtatatgttactttcaacatcaaaaagtaagagttctcaaagagcaaatatttctggaatcattagagaagaaatggatatactaggccaattgaattcctaatatatgtcaatcttaagcaaaagtccatttatgtgttgtaacaaaaagataaacacaatgacctgacattgagaatgtttgggtttaaaaaatttataagattcaaagcatttttcactgtacagaattataagaatcccaaatttctatttctctctctttcttcaggtaccaacactaggtcttgaaagctagggcattttgaacaagcggcagggtgacatagagtggcaagaagtgagcggtttagatgatgtgtacaaaaacttcttttaggaggaagagtggggggccaaaaccagagtagccacctccattgtgcagtcaaaggatcagtgataggagaggcaacagaatagaacaagagatgtgattaatggtaaaggattcaaaactgtccaatgctcgagctagtcaacttatcacatcattttctcagtggagcctactaatagatgtgtatgtgggttaacctaggttacagatctagaactgtagagcacaatgaatgatatgtggaaggaaaatgagaataaaacctagaaatcttcagtaagagtaaaattgagagtgttttggtctttcttgccttatttaacttcctttgaattcaaacaactgagtcttctctagattaaacagatttttttctttaactcagttttaccttcttaaattggataataattttctatatttagaaaaaatcttggttacattttacaataaccactttatagtcttcataggactttctgtgctaaatgttatatagacattaggaaaaatgggaagaatttatgtactatacttccttccatcagtacatctgtatatgcatatcaagataaaaagtatagttttaaaagcagaattcacatccttactgcacaaataatgttgttaaatggagaaatttgaacctaataagttgattttaaaaacatcaaggcgtgtatagcttgtgtctatttatatgaagtaaatgtctttctcttaatgaaaaagagcctatgttttggtcatttatgatacccgtagtaattatttccagccttggtttgatctaccagctctttttctcctctgaaacacagcctcagccccatgagtgttgttctgtgatctcaacaggcctcttgatctaagtttactgttgttgttattcagtgaagagcataccgtctaccttttgtatataatagaacacatttatgtagtcctttataatttgcaaaacatttcccaaatataagctctgctaattctcacagtaaaacccagaggtaggtatagatgaggaaagaatgacttaatgtgcttaaaggacctgccccgaacaaatggccaaaacttagactcaaactcagtgtctataattctgtgggtaagtaacaaagctagagctagaatcttgtcaactagagctcagagtaactaaactctgacaacagaggcaaggcacggcaaccctttactactgtcttattttcaataaactttatcatttggagaattaaaatgcaagaaagtatagatacacatttatttataaaagtaattattattttaattataagcaatttcttggaaagaatatctgcttatttgcttatttgtacattatatttatatcagtttgttgatttatatattagttatgtttggaaagtttggtgctgagacaaaatgtttatatcaatgctcattttccttttatctcacgttatgaaaaagaccagaaatgaataccctaaagttatttagctctataaactacctttattgtcataaattatcaataaataagataaaaaattaggctatttaaaaactcagatcaaaggatagattaatcatctgataaaaaataacccagcaaaattagtgaaaacaaccaacttttgaatagtcatgaacacatgggaataagttagagaaggaggaacatacaatgatctaatttatcggatacccaacatttctttgtattatcataggggatgaataccacccactagaggaaataattacgatgctgtcagcacaatttccatttgagcaggtttctgtatatggaatgcacagatcctgacaactagaggaaattctagtaatgtggagtgtagcttcatttgttgagcacttattatttgcaagtctctatactaacactttgattcactataccaaaccctgaaagtttaggaaatagttgtccttattgcatggatgagaaaactgagacacatggagggttaatcatttccactttgcacagcatcacaaagctattaggtgatgaagctcaactttgaacccaggttgtctgaccccagaatttatgttcttaaccattgaagttaaccacatctgtcaacataatttagactttaaaatttccggcaattattcacacagacatgttgtctgaaaaacaacatatttgcttttgtacttttttcctcagtgagtttttgtctttttcacttaggtttgaacttgtcaatgaattttctcaatcctgcttccttgagtgaaaaagttctatgttgtatctgatttttgccatttgtttttgctctatttttcctctcagaaagaccatccttattagaaagcactatatataaaataaagtagccagaaagatcaatctgtttatgtaaatcttactaatttatgtactactaccatctggattccctaatttttgctaattctgttaaataaatatgcttacatgtaagtgcacatagaaatctgtacatgatttacatgattgaaaaaattcaacttaaagcataatattaccttaccttctgtacacctttaatagcatatagcgtttaccctttcatggactgttttttcatggtttatccaaatggctcatgagcaacccaaggtagtagtcatttgctttctcccccccccagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctggtaggaaagaaacatttggtattcacaccctttgggtaacaacactagcatgttagcaactcattcattctaaaataaggattaaatcatttggggcttatttctcttatatgcatatatttaagggaacatgagtatagtgctttgcacataataagtgctcaatactttattgctaacttaaaataggaaagtctaaatgaaggagcaaaataaatatcatgtaagagattaggtatatttaaagtccaaagtgaaagattctctccaaaatgctccattgcaaaaggaaccttgcatttatgcaattacaagtgaactatatgtggatataatatcctggtaacaaactacaatatactggaagatacctggtttactaactgatgataattatttatactatttgtatggccaacagtcttgtctacagtgtgctccctaagatgacactttggtagatggccagttcatcattttcaatgcctgtactgcctgataatcagttattatgagttgggaatttggctaagacctgcttctttacaagttgtattttcctaatattgtaatcattatactgctcatttccagatgtcctttcctgcataaccacatcacggacttggtaaatgtatgctgatgaggatgttatttctcatattttatcaagcatgaaattaaatatactatctcaaaggacttaactaataaaaatgatatgcgggcaaatgtgggtatatatgtcgccaacttccaaatatctatggactgatcatgttaaatttggcttatcccaggtaaaaatcaggttccagtttaatactgtacctttagttacttaactcattttgtcatggtgcttgttttatcaatagtttccaagacagctgaattgcatagattctatattaacttttaacatgccagctctgttaaaatttatggcacctttattattttttgtttatttattgaattaattatttttgagacagagtctcactctgtcccccaggctggagtgcagtagcatgatctcagctcactgcaacctccgcccccctggttcaagcgattctcctgcctcagcctcccgagtagctgggattgcaggcacctgccaccacatccagctaatttttgtaattttaatatagatgcggtttcaccatgttggccaggctggtctcaaactcctgacctcaagtgatctgcccacctcggcctcccaaagagctgggattacatgtgtgaaccactgtgcccagccagcaccttcatttaaacttttcaaatatgaacttttaacaaccacccctatttccatgaaagtctgtatcagtttgcagaacacaagcacctgttcttagactgacattgatttcaggaatctattgattaaggattaaagaacaaacaaatgtcccagcttctccttaggcaggactacatgattcagcaggactaattcgacaacatgatttcttcaactcattctaatcagatctctgctgtcaggattccattgtgactacactccttgagctctctggaggcctccatgctgccatttacaatggttacttctctgttcttattttaatttacttctcagcagaatttttcataagctgaccacttccttcttctgagaaattctcctaatttaccacttgctcattatcagtttcctgtactagaaattttccctccatgctcccactttaaatattgggtagctcagggttttgtcttaggccatcttctctttctacaccctgtcccaagatgtcttcatcaaatactagagcgttaaatattatctataggccaagattcctaaattcacatttctatccctgatctcttcatgggactctagagtcaaatgtttagttgcctatcaccacatagctctccaataaacaattgaaacttaacatggccagaaacagtcttgatttttttctagtcattttgcactttcccaggcttcctcattctggtaaacagcatcgccattcacatagttattaaaaccaaagactaagatcatccttggcccccacctttatccttgttaatgctacttccaactcacacccccaaagttagttacaactccacaacaagtaccatgacccaagccacgatccctgctcttcagattttccataatatctaaactggttttcttgcttcaactcttgcctcatgcaacccattctccacagaagaagggtaaatatctttataaactatctgtcagataatgccatttccttgcttaaaaccctacaatgtttttcatcacacacagagtcaaaatcccaaagagtgtgaatgttaagttgtgatgagattaggtgaaggatgccagtagagagagagaacttggtgaagagaaagagaaaagatccccaatgctgaaaggaaagggatctagaccacaagtatacatacctgaagactcatccactgcaagtgactgtgattagtctaaggatgttgtggcaggagtttgagggagttcaagcacaaactaagataagtcagagagtgataacctctggggaatgaggagagatgggcactatcacagatttgaggggaatgaaaaagatttgaaaaggctcctatggaaaacactaaagattactaatttaaaaaacatataaagattggcagtgttagtagccagttaaggttaaagatcaagaattaatagagtagtattttgcaaactttaagatgtatcagaactacttagagaactttgtaaaaacgcagattcttgtgtcccattctgagagattctgattcagtatgctgaagggggctctaggaatttgtatttgtaacatgttcctaaattatactgatgctgctggtctgggatcacactttgagaactactgttatcacgttatcaatctgccttttctccattggcttttatcagcccttatggaagcatgaagaaagcaaacatgttcaaagttgcatttttgtcagatagtgcaaaaaaaaaacaataaataaaaggagttaggatattagtaaaaaaataaataaataagagtggctgactagatgggtcatggaatctaaccaacagggaaggaaaggaacacggttgtggggggcagtttaaaaatgagaaaataaaggcacaaagggaacaaaaagcccctacatataccattaaggactagagaaagaggaactaaatgaataaaagaaaaacaaagtctgtacttagggaccgagatatttcagaggtggacagtttaagagatgatgagatgttctatgggagggagtgatagaagtgggatcagtgcgaaagtcacagcagatgaagaatctaaggaatgaggggctcagatgcaagatgagtcatctacatgggcatgaagtcactccaaatattggatgagagggtgaaagagtaagacagttatggaaaggctgacaagaaagggagggcatggccaatttcagtcccagatctgtcattatcagtccaattgaactacctaaccaaataacttctctgagtctctcttgactttctttttttacaaaataggcaagatcagaaatttcaaaaaccattctgtttcagttttactctggatgcatgtttcctaggagcaatatgtctgaaagagcaaggcttaaccatacagtcatggcaataaatccaaaccatggtatctggactatactctaaacacacagaaaatagctgattagaactgagcacctgcctggaggtactcatcaggttttctccctcaaccctggtattatcattggaggcttagggaactagagataaatcctatctctattatatcattttgtttctaagacttggaaaataataaatgaggaagggtttaacactcagtccttgcaatccggattgaaactaaggagtctctcctagtgattggccaagagaaaattccctagtctggtgttcactgttatctcctttccaggctactgaaccaaaccatccttggttcccaaaaagtgaaataaaagcacaaatattttctttttaggtaataaagggcatcatagatttgaacagcaaagatacaatataattagagtttttctcacaaagaagagctggtatccacatgcccatttggctgctcaaggcaaatccagaatgctcttgaaaaagaatgaacaggaaataagaattggatctgaagtgaaggaaattcaacaaaatgagctagtagggtagctgtaggtggtggtgccccttgtgaggtggtgagaagccaaagatatgagcacagactatctacataatgtctagttctaaatatacacttagtgaaaatgatttccatgaagcaattctttcaactaacatttgggaatctatcatgtgtgcaccaggtgctaccaaaaatgcagggataactaaagtccttgctttatgtatgaaaggaaatgtttaagagtatggctccttgtctcaagtagcttagtgtcttgtagagagaggactgatttcctggctgggcatggtggctcacgcctgtaatcctagcactttgggaggctgaggtgggtgaattacctgagatcaagaatttgaaaccagcctggccaacatggtgaaacttcatctctactaaaaatacaaaaattagccgggcatggtagcaggtacctgtaattacagctactcagaaggctgaggcaggagaatcgcttgaacccaagagacgggggttgttgtgagttgagattgagccattgcactccagcctgggcaacagagcaaaaactctgtcttaaaaaaaaaaaaaaaaaccaacatggcacatgtatacatatgtaacaaacctgcacgttgtgcacatgtaccctaaaacttaaagtataataaaaaaaaaaccagacagatgactgatttcctcatgcacaaaaacagaaaaactaaacaaaaaacaagctcggactttataatttataagcagccagccaagactaaaaatctgtgattctacaataatctatacctatatatttcagtagtgcatagaagtcaaaatttggatttatctacagttaaattctgtattgatgcactatacatacactatgaaaccactactatagtcgtgtttctgaataaatccactagcaagtattcactgattgactgctggggataaagaaggaaaataagaaagatatgaactaactgaggataaaggccacagacaaaaaatacaatgcagcatgtcatggtaagaaccatacaaaaaacatagtttatagttggggaaccagacatagccactatggtcaataaagactcctggcagaaatggggttggaactttaccttgaaggatgacaaattagagaaacgacatgtgctaaaattgaataaacaatattcaaatcatccttcattgtccccagatcattttatggaaaatatatttaaaatcccaaaagcattagataattcacattatacataggtaggtaaaggtgaattttaaaaaataaaaactactggaaacttcacaaatacaacatttcaatctcttttattctctatatttatatccaccaaatctgtattcccctttatataaaataacatcatccaaaattaaagtggcctttgccataatggaaatactataggaaagctagtgcttaacacagtgctaattcaaaaaagcaaatgagctctcctcaggtgtatgagaaaaggcttctgtgaacactctaggacattataaagctttcagatgtgttatggagccttaggctaatccagtgttttccaaaggagagtttttggtcaacttacactcaatacctggggtgctaaaatgccaacatagattatctcaagaagcagccctggaatctgtgctttatcaaaccaaggtttgaaactacagagctaaaccatcaattcccaaaggaaactatagacaagcaaaacatttaaatggattaaggagaatttgagttcttttgaattctacttataattacttttccttttgctgactacacacaatcaaatcaggcaaatctagcaagaatccacagtagatttacctagctgaactgtgtaatacttagacatgaaagctgagtactacgttgtaatacatctttcaggatttaacaaaacattcaactaagcagtaagtcacctgggcttaccaggtattgaatttctgtgcacactggggaaggtctggacctcaaatccaatcctgcagttgaagacaactgaaagtaaacattctggtacaccattgaaaaactggaatgcataaagcattctgatcagtattcttggtctttctttataagaaaggctgaaaatgtctccttctttttgagactttttgtttctttcctaatgaagtccttcacctggatgatcccccttatcaactgcgcttctctttctttttcttatcattttgaatgaatgctggctagaggacaaacaagaactgtgagacatgttccacaaaggtagtgccaactgaattagttggaattgtaaattacaaggaagaaagtagtactcaatctgttggattttggcatgtatcttagcacagcattcaaagaccttcatcttgaactctgtcaatccatcatatgctatcttccctgtcctactgagaatagatattgagggcataaagacagcagtacccttatttggatggagttagggataggatgaacagccatggtgaatgtgtcctgcaactgacctggcctaggtgacctgcatgggtcatgcatgtccactggccatctgttctcaacagaaatgggatatgactcagcctttgatgtgagagaaagtgtaataagcaggtatctctgcttccagctttccacctggaatccctcctcttcaagagttctgatccctttgtaataagtgtcccctcttatttcagacttgctactcttgccatctcacttgatttcaatcatttttattgtagttaacgaactctgccattaaggcaaaatctctcctggaggttggatggcttaactgttagaaacaagagctctgcctgcagtctgacagaagcatattcaaagtcccatgactttgagcaagccacttacctgtgccttcactggctttagtttttccatctataaaagagggttgacaataatatgtgtctggctcacaattgccatgaggagtgaatgaactaatgtctaaaaggcacatgcttggcacagagtaggcattttgtgctactctgtagttacttaatctgtttgattttgaattttgtttgattttcgtattttagcacagcattcaaagaccttcgtcttgaactctatcaatccatcataagctatcttccctgtcctactgagaacagatattgaaggcataaagaaatcagtaccattatttggatggagttagggataagataaacaaccatggtgcatgtgtcctgcaattgacctagtctaggtgacctactgcactatgacaaaaaaaaaaaaaagacttagaaagtcagaaagactttgttaagtcttttatgatgtagagcatttgtatcctcttatatatttttttccaaagtcagaaaaactttgccaagtctttccgtttttattgtagggcatttttatccttgtgtatattttctggtttgtgtgtttgtttgtttctttgttttgagacagagtctctctctgttgcccaagctggagtgcagtggcgtgatcttggctcaccacaacctccatctcccaagttcaagcaattctcctgcctcagcctcccgagtagctgggattacaggcacccaccaccacgcctggctaatttttgtattttagtagagatgaggtttcaccatgttggccagagtggtctctaactcctgacatcaggtgatccgcccacctcggcctcccaaagtgctgggattacaggtgtgagccactgtgccaggcctgtattttctgttttattgtcctacttaacttcatgcatttaattttggtgacccaaatgtttccatgcatttccagacatgggataaattaagtcacagttatattaataataaaagtctactggctttatatcagcctctgcatagctgcaataccttgccactccctcacaatctctcccagctgcttctgggagtcccaaaaagtatctcacctgtgctcaggagcatatctgatgatgtgcttcttctacctgcccactacctgccctcccccttgaggatgcagccttgccacagactttgctgctgccttttgtgagaaccagtatgactctctcacactcagaggtgcaggacccacaaggtgcacttggtgtaagatcccttcaggtctcattgtgccagagaagccacatcaggttccacattaaagttgcaaggacaatgccctgtccccagctctaaactgcaagttgtcaccaagaccccaagtaacacagcctaaagcctgaaccatgagttctactatagagcaaagcagctacatgagctaatgactgaatattttgcaataactccctgcttctggccttagtcttctgcagattgttctccaaagagctgccaatttggctgtgttaaagctttagccaggctatttcattgtacttaaaactctctaataactgcctaccttgcttggaatagataccgaagtccttacgttgatctacaaagtcttgcgtgatctggcccctgctacctctctgatctggctcctagttctctcccattcacaccacatcagctctgtagtttccaggcacacactgctcagctcctgtttcaaggccttggcatttgctgcacccctgaatgtggggacaaggagaacagagggcaaattataaaagaccttgatgctttactaaatgtttgaagtttattccacaaatttcatataagtaaacctgtacttacctgtacataagagagaattggaatgcaatacaacctagtggtctgatgcaaattttttggagtcagatagagatagggtctccagatttagcaaataaaatacaggacactcagttaaagttgcatttcagataaatagtaaatgattttctaatataatcatgtcccaaatactacatgaaatgtaccaaaaagtgttatttaatttgaaattcaaattcaactgggtttcctgtattttatctggcacccctacatagaaatggaattgaatactggccttgaacaaactatttaacttctttcagccttggtatgaaaatagagtaataatacccacctcatggggcttttgtaacgattaaaaaatataatgcatggactgcacttagcaaagtcactggcacaaagtaaacaagtaaattgccgctgttatcattattgctattgttatgatcatctcattttgccagtgaagctttcaataaaacattacattcctagcaacataatcttcatatgaaactttgtatttttaaaaaccctggattatccaaatttgttaaaaaagcacttcttatttgataagaaagacttcaggaaacaaatgtaatattctgagaagaattatgatttgatttcagtttgttaaatttttatttgattgtatagctctcagcacattcaattcaaaacaatttatttttaaattccattcttatggctttcttttttttaataaagataacactaacagtatcctgtgatgatatagggcttttgcttcagtttttgctatagatttgttctctgactcatgtgatctggccatgaatttagtaacagatggtaacttgtggttttatgaaaaccgagtatgtgagaagccttacatatcacattttctttagtcacccagacacttattcattaaaataacaaccgaaagaatttttaattaaataatggaaactcagtaatgtgccagatattgttggttgcttaagattcaaagaataagacctactggtttctggtttcacagagctctcactgggtagaagagaagatgttgcaaccagaacaaataagtaaaacagtatgataggtaaaaatgtcacataagtcatacaatcgggtgtaggaagtgagatgatagagcagacttcacaaagtctgtgtaacattgtagttggttcttgaagaatgaaaaaatgtatgcaaagtaaaaaagaattagatggcattccgcatggaaagaacagtatatacaaggaagaaaggtatgaaagaattggggaagttgccagtttagtttggctaaagcagtggaactcagaggatggcccagaaccagcagcatcatatcatgtggagtatttgttagaaatgcagattctcaggctctaacccaggcttactggatcagaaactctggggcggaccccagtcctctatgttttaacacgcattctaggtgattgtggtgcctactgaagttcgagaaccctgaagtacaacagtagagttttcaaaactgagtgcacatgacatcactgagggtgcatctttcataaacaccaatgacaggggccacaagccataaaaattaaatcagagtttcagaaggtggagcccagaccaaaagtctaaagatgttttactgtgcagccaaggctgagaaccactgggatagagcacatggtacatgaagaagaaagggcaaatagacacttcacaaaagaggtaaacacatgaaaactcactcaaaatcatcagtcttcaagaaagtacaaattaaaaccacaataaggtaacactgcacaccctcactcagactgaccaaaattggctgctataactaaatgctggcaaggaagtggagcactagtgtatcattgcaattaaacagacagaggttgcctgaagggtaagggtgagggtcagggattgactttcctgaaatgtcattccgtacctgatcctggtgaacacccacttttatttcactactcggttttatctggaaaccttcctgaaatttcaagttactcaggcacatcctccacaactcctgcaaacctctgttaggacacttccttcagtgctgctaccactttttaaaatgcctttctcttcaactagatttaaaaccgtttgagccagggtgttcttttttctttgtggatccctcacgcatagcacagtatctagcatttgtatggggatggatgagtgagtagactgagggatgttgggttacctgatgattttgacacaccgtgtcatgactccatgcatttacatatgctgttccctctgcctggaataacccattctaccttttattttgtctgtctggcaaaaacatctcctctcttaaagatcatcattctgtgtcacccattccataaatctgtcccccaacaaggacacatccatttggatttgcttctttctttaggccatgctttgtacatagctcctcacacttaacttactatattgtaattaatgattttccttctttctggatcactgatttgtacatttctcgggggttatttcactttgtatttttcctcagtgtagtgcttagcatatgttaatgttcataaatatctgttaaagaaagagagaggaaaatgtcctcagactacctcaaacatattatgagcattttaagtgcatttttattgtctgtcataatcagattgtgttctaagtattacttttgtgtgcatcccctctgtgattttgaggattattatacaaagaatggaagcaaacagttttcattatagcttaatcactaggtcattcaggcagcagcctgagtcttgaaggcactgaggaggaacaacagaaggaggcttaaaaccaacacatcaaagtcaacacagcagtattgactctatcgtgttggttttcagtggttctgaaatattgtctcccacgagtgatagaaatgcaaatttgaagtaacctgaatttagttagcaaagctagaatgctgacttataaaacaaaccagaaaataagacttcctctcactcctgatctacaatttttaaagccaaaagaaaagagtcacaagttcataagaaagtaaatttcagaggattccaaactaaagtatgcccagataagtaagatagatgctgtgatttcaactgcagctatcagtgcagctatcaaacaacgtgatcattaaaaaacaagctttagttctaaggatttttgagatgttaagagtattgtggtagatacacaattttcaaacagcctctcatgatgttaaaagccaaataacaaatctagagtataaatattttcaccatttctgagtttctatacagaggataacacagggggaagagaacagaaagattctggagtcctttggaaatgagaagcagcttaaaaataagctttaaatatacaaaaataggaaaaaatagttacttttctaaaaatgctataatgtgttagaggaaaatggagaaatctaaagtcttaattctgtgagatttcaaaaagctaattatgaaagtagttagaaaaacaaaacaattctgccaacaaaaagacctctcccggctgggtgcggtggctcacgtctgtaattccaacactttggaaggccgaggcaggcagatcacctgaggttgggagttcaagaccagcctgaccaacatggagaaaccctgtctctatgaaaaatagaaaaaaattagccaatcatggtggcacatgcctgtaattccagctacctgggaggttgaggcaggagaatggcttgaacccgggaggcagaggttgtggtgagccaagattgcaccactgtactccagcctgggcaacaagagcgaaagtttgtcttaaaaaaaaaaaaattctccctatcaatatagtaggaaaacaaaattttttaattgcataagcagtaacaaatttacaagcatgtaaggtagcaccaaagtgaccacaatgttagtgtcatagcaaaaatagcaatggatgaagttaaaaaagcaaggaagatttaagactgtttcaacagaaatcaagactattgtagtaagagagagattgaactcagctctgctgaaacaggcaggagagattttaagcactggggtaactagtggaaaagtactggaggatggtagaggaaggtgggtcagtgtaattaggccatctgtgtttgctaattgctgcttatctaagttaggtttacacctcccacagagactgagagatagaggttgcttcttacttaatgattacagttcaaaggaatgattccaggtccttaagaaatatattcctgggtttatacaactggcaagaagctgggggaagatttatatctccaaggggcagaggaaaaatttacaaatacaatttttctaaagtaaatgctctaagaaaagggaggtcaggagcctatagtcaggaaaaactccgtctaaagttttgtcaagccctcttggtcatcaggacaaaatctcacacattttatttggccaaacagaagaaaggacaattatttcctcaaaagacaaaaaatcgtacctcatgacagttttctgaacaactcttaagagatctcagaggtaattccagagctacatttttacatttgtcaagtaaaaaacaaatcaagacttagtaatgagagacttatttgaaagggctattgcaaggcgggagagggactactgcaatagggagaatgctttggccatgagatccgcaagcatctcaagtactaggcaagaagggtttttcttttatgagaggagtaaacaagattagaaagaacccagggtggagaagtgggatgaaagactggcatactaagtaaatatatcagaggatgttttaccctgaagccagcatattttccaggagggcccttaaagaggggatggatcctggctcaggctgaggatggactgaagtttggggtcctgggagaaggagagactcttatttgattaataagcattttgttctcattgaccaatggagacaaaatagttcagttagtcatgaatgagggcaagagtgggaatttggaggatctatgtctggccttagcataggtaaataagcaggtgtgagtcttatctaaatcaactggagaagggtggttctttgcaataagccatttcccagaacaaagggtttcttaactatcttaatgaggctcacataaaattcaacatcatcacatatccagaggttatttgactcacaatcttggagatgtgttaggccatcctcacattgctataaagaaatacctaagactcggtaacttacaaagaaaagaggtgtaactggctcacagttctgcaggctgtacagggagcatgatgctggcatctcctcagcttccgaggaggccccggaagtataatcatggcagaagatgcagcaggagtaggcaggtcacatgaccagagcaggagcaagagagaaagctaggtgccacacactttcaaacagacagatctcacaagaagtcactcaccattgtgagaacagcaccaagaggatggtgctaaaccattcatgagaaatcctccctcatgatccaatcatctcccaccagatcccacctccattactggggattacaattcaacatgagatttggacggggaacacatattcaagctatatcatatgtctacactgtaatcattggagaatgggcttaatccctaataaaatttattttgatgtcaaaggtaggaggaaggacacagattcaccaggcctccaaatagacactctaaaaatggggaaacgggaagtcagtgtctttgccttttataatggagaaaatcgtttccatttgcccttacaaagtgcagatatacatttatcgattcagttatttgggtttcaggttcagatggacaagccaaatcactgagtctctgaggctcacttccatatctgttaaaggaagtttttttgggttattgaaaagattaaataggatcatgtttatgaaaatccctgctatgggattttgtatgtcaaacttaatattttcctcaagtaacaaaatttagtggacatgccaattataggaagttttagtaacattgaaagaaaaaaattaaaatgatttggtggctcatgcctgtaatccaatactttgggagtccaaagtaggaggatcacttgggcctaggagtttgagaccagcctgggcaacacagtgagactcttattttttttaacgacttggttatggtgtttatgcataccccttgtaacttttatgtcttaaaagtctagaatattttattagtaatcttgtatctcacatcaagacactcttttgaggaattctctgttgagctggggtatagtgtaacaccaaatcatttgaaattgctgagaaaagttgcagtgatctcaaatttgaaagaagttattttcatttatatgggaatactaagaagaaaggaactaatcaagataaaacagttgatacataattatcttatttaaagagaagggtttgtcattatttagccatacaaaatctgaccacaaattctagatctttgtattttggtcttttgaatcccaccccatccccaaccctaaccttcaccctttggtaccttagtctcctcacattgccctaaacacagagagacagactagaccactcacaggcaggtgactgaacacacacacatatgagggagttctatgggggagaagtggcatcttctgcctgcccaggaggtaactcccattgttctataaggatgagtaagatgctacatactaatatcagtaacatagggttcttaaatagccttgcacgtagtttgcccagaatgcctatttttgtgtagggtgggccaaacccgtattatagttctatgatgccaagccaaatttattaaatcaataaactcttctaagattctgagaggcaaacaagtctttcccgtcttgtaaattattcccaaattccaaagggcaaaagctattggaaaaatcatcttagtgacattaagagttttatgcaacagaataataattagtctagatatgtgttttgcccttaatgccatttttattcactcagccagcaaatacttattaaatgattactgtactcaggcaccattgtaagggctgagtaaaaggaagtgaataagaaagaaaaaaacctcttttggggagaaagggttgcaggcaggccgcttcattctcaaatcgcagattatattctaaaacatatccaagattcacattctaaaatatactattcaacctgaacacattctataaaactaatacagtggagtatgactggagtattaaattcatttttacttcagtgcccattgttacgcctcattgttatttaaattcagacttgtccattaaaaggtctatttgtaattcactgaaaaaaatagatgatatgatagatattgtaaatagaggacttatcaagataaggtagaaatatgagcacaaggtaaattttgttaaccatcgctaattgacctgtgctttctaaatttctaggtttaaggaaactagtattaaaacaatgtgatttttaatgccaatatttacacaatttttgtaagaggtaaaatgtaatttgagcaaataatgtaaatataagagaaccaaaagaattttatttctataagaaaataatttcaaaatatgtgaacacatgcttatgagtatgcttaaccaaacctattacatatattcaaaactatttccattttctgttagccactcatgagaaagaaatagttcacgggttgtctagtgattgtagagttgcttcatttgacttttaaagtatcattttaactagaattacctccagtttatgggaaaatgtaaagactctacaaattgcattggttaaaagtaatcctaaaaaatggcactgtaaccatggaaatatcatttagactcataaaattttaaccacactttttttttattccctttctggtttctatgttgcctctgttcactgtggcatgttaggtgcatattccacccaattttcttatgacttaactgtttagtttttaaatgggagaattgtctgccagtgaagagagactgaatggaagaacacttaacatgagatctaccatctttaaaacattttaagggtacgatacagtattgttgactatgcaatgttgtacagcagatctctagaatttattcatcttgcttaactgaaactttatgcccacttattagcaacaccttcatttctctctgccccctggtaactaccatttcactctttgattctacaaatttgactattttagatacctcatataagtgaaatcacacagtatttgtcttactgtcactcagcataatctcctcaaggttcatccatgttgttacacattacagattttccttcttttttaaggctaaataatatttccttgaatgtatataccacactttacaaaatccatccgtcagtggacatttaggttatttccacatcttggtgattttgaatagtgctgtaatgagtgtaagagtacacataactctttgagatcctaatttcaatttctttggataaacacacagtagtgggattgctgggtcatctgatagttccctttttatttggggagagggggacctccatactgttttccagagtggctgcattatattgcattcccaccaacagtgtgcaagcattccaatttctccacttatctttgtattctaagaatacacataaaagtaattctctttatcctattaaacaatgaatttttggattcctgacacaacaatgttctattccttgaattttctggcactaccattatatgaatactattttttttttttttgagacagagtcttgctctgtcgcccaggatggagtgcaatggtgcaatctcagctcactgcaacctctgcctcccgggttcaagcaattatgcatactattttttttaattatcctcatttctttcttccagagctacatgatagtaatactcctgtttcctacaatctataagaacactggaacctttagttgtgtgtttttttacattccaaacctaaaatgttttgaatacgtaaaatattctacacagaaataccagaagctatttatttcttagaaacatccagcaattcattgaagtaaagtgttaaagtgtatacatattacacaagccaattcccctacattgtatttattgaatagattaatagacttttctgggaaaaggtaattaactgtaaatgctgacctctcactgccttttccagaggttgttgaacttctgtggcctaagtattttatctgccaaatagctagaaattcttttcaagtttattttttaatgctccaaatacaaatataattgattcatttcccagtgtttcacaggcacaggactttaatgatttttttctagctattttttaaaatattgagtatgatgagctgtaaaaactctaaaaacagaataaaaataaatgaatagacaaaagacaatgttcatttgataaataccagggcaagaaatttgtacttgaacaagctaagaaagtcattaacagcagtatttctggaaactaatggtatacctgctcaagctacactgaatctaataatctgtgacaaaagaaatggcaacaggtatgaacacatttcatttaatctgaaattgaaagaaaagaaagtggggcacttttcttccccaacttttttcatacctcaacagacaaaatcacaatggaaaagagatttattgccaaaatgttgctgaccttttacaattcttgccccatattctggaagttaattgattaaaaaaaaaaaaagtacattttcatggactggcacaaagattttatccagatagcattcaagttgcaaagaggcatcctctagctcagtcccttgcatggtgcacctttgtcacccaccagccaggactgtgcccagctggttctcccctcattaagtctctcaccggcacaaccatgctgcactatcagccttgccctgcctaaggatcttcccttctaaaccttcgctgtctttagaatgtctctgaatatggaaaatcacaagctccggggttgcctgctccaggatagcctgagatgaaatgaaagttcaggcctttggaaagctggtaagaattcttttcacctggaatctgataagtatcccggaaaccttatgcatatttgatattttctgccttgccacagttttaggaatacattttaataatattaagtaacatttcctaaaagtaaaccttcctagcctgtagtctactggaaataatacctacccctgctatttaaagctgtgtgaattgaacaagttctggaatcactttgggccttagttgtttcaaaaatgtggaaaacagcttatctttaaaaaggcagaaatctgagaaaataagatatagcgtcacacacacacacacacacacacacacacacacacacacacagtgaaaaactgagaggatttttattttattccaagtcaggaagaaacggaaagaaaacaatactgtttccattttcactaccttccaggaacaatgctgagttttttatatatgtcttgtcattactgcctaaaataacttcgaggagtagctatttcacaaataactgattttagaaagattaagtaacttccccaagctcacactgctcataagaggcagaatcaacctgcagtcagggtccgtaagattctaacacccttagatattttcattgtattagggtttccacaaattttattaattttgatatgtatagtacccttttggtttgtgccaaatctatgcatcagtggtactattttttacttacttattaaattacctcattatttaaaataaatgtatcttttacactaaactttagttcactctaataaatgaaaaaccaagcatctcttttcataagttggagaaatatttaaaataaatataatgaaaggacaaaatttaaaaaaaaaccttgatatttgtgaccaaaaaaccctgtgttcctgctgtcctctcctgtttctctctcaatctctctttctcccattaaaaagaatagacagtactagagaaatgttaagactgacacaaacataaactttctcattaatgcaatccaaagaactggaagagcagtgttctcactacatgagtcaatgtttatattttattgtatattgataaattataattgcatatatttaaggggtacaaagtgatgttatagtgtatgtacacatatgtagaatgattaaataaagctaattaacatattcatcaccccaaatacttatcaatttttgtgatgagaacatttgaaatttactatcttagcaatttcgaaatatacattgcactgttattaactatagtcaccatactgtgcaatagatctcaaaaaacttactcctcctctctaactgaaatcttgtactctttgacagacatctccacatttccctcacctccctgtttctcgtaaccaccattctactctctgcttcctacctctgttttagattccacatagaagtgagaacatgcagtatttgtctttctgtgcctggcttatttcatttaacgtaatgtcctccaggcttatccatggtgttataaaagccagtccttccttcttttcttaaggctgaatagtattccattgtgtatatatgccacattttctttatccattcacccattgttagaaactcaggtagatgctacagcttgactattgtgaataatgccacaataaatatgagaatgcagatatcctttcactatgagtcaatatttttaatgaatcttcccatataacaatatattgggcagccctagcagtttgtgcatctccccaaaacccccgggaaatgcagagctcaatcctgctgatctgcatttcgtgcttgacaagttgatgtcactgaatgatattctgactggatgtcaccctccagcacttttttttttttttgcgcaactttctacttgaagttggaagaaactctgcatgcagatcgacttgttatatcacattggaaaagtaccccacattttacagagtttgatacctcacaattgttaaaagtgagacagcatttccatgccatgtattccaaatccctgaggatctcagcaggcagatggccctctaggtcactagccactgctgacaacatggatgccctcacctgggctctgtctgtgacatgtctaatgatttccatcaaaataggatattgccttctcaaatgtcctcatttttaacaaggaaagcttatgacacacacaatgaaaagaacacttaaagtcataaatactgtatacacatttgtttctatagagcaagttgattgtagagaagctgccaggctagtgcccaaatgttcctgagatagttcaataaatatctctttacaagcctgttattgcctttcaaaggatgtaaggtctcaacattcctaattaataccataggttttgtccaaagggaataggaagaaattaacacaaaaatactgaaatagatacaaataattttgaataaaccttctatttatataacacagaactggttgagcattagctgctaaatataatagtattactatttgggtaacaatgatgttgagagcttaggcatgatctaaattgctgtaaataggagagagtgtatgacacacaatggtaagaaataaaggctgtatgaacaaagcactgggttagttacagccaaatatgaagacttacgtgacttgagcaaatgacttacctctctgtgcctcagttttttaatctataatatgagtataaggatggcacttccctcatggtgctggtgtgaatattaaatggaaaaaaatatttaaagtacttaaaagggggcttgacatatagtaagccctcagtgcatgtaagtttttaactaaataagttaagcctcaaagtcttactgccaaggaaaaagcagtgacaaaactatttaaagaacccaggtatattaaggagaaaatttcagtttggtgttctctaacaattaactaacaggtcctcatctcccactttaacctaaagaatcagacactcatactttgtttcaaacaatagctaattagattttaataacaaatgaggttcagaaaaggatggacagaggaagaggctgtgtcacagtagagaggcatccagggtatgccagttataacatgcccccttagcacacctacacaatgctttggatcaagagaaaaacatttttcatgacacttgcaattacaatcaaacatgaagcaggatggtgtatgaatttccatatgtacattctaaacatggcatggttctatttgtactgccaccatggaaaaattagatatttttttcaaatgaaaactggaaatgaagaaaaagatgtcagagaaagatctacttcttctactctgttagtcatactatcaaagtcttgggctataagatgttaaatgcttaaaatacatgatctaatatcaacaggggtacctaaaatacagacagtcacataaacatttcataattaattacgctgataggtgtcatatgttattatgtctaaatgagacagctttcaaatctcaaaacaaaaaatctgttaccatcaatgatgatgttaagggctaaaaagtttataaagtaaaaatatatataagagataagtatgaattctacataaaaatcaattacatctaaaaagcacttgaaaatgctctttatataatcatgtgcatagcttctcacctcagtactgattgcacttcagtcctctgaaacttacctgtgtgccagagaatcaatctttgttcctgtaaaatataaaatatcatctgtttttttaaatcatttacctttgctataggaaaaataatattaataatataaatttaaatcacctgaaattgtatatttatatgaaaactaataactttgagataaggcccaattattctaaaactttacccagaattttaaatgatttcaaaatttaagatatatttcattttctgatattcatgggcatgtttgatctccattatttactgatactaagcaacaaatagatttttctttgagttgtttctatcaacttaaagagagtaactatatctggaagtattgatatattagattgaaaaatttagccaaaaagaatgacgtgagcaagatggcagaataggaaatctgaggcttaatttccttttctccccaccagaaagttcaactagcaactatccattgcagaataggaaatctgaggcttaatttccttctctccccacaagaaagttcaactagcaactatccattgactagaatatgcttttgaaagattcagccatatcactaattttttattcctatgcaagatatggtattttctatataagtaataaaactggttatatcttttcataacccaaacagatccaatccatgagtcaattacattgaaatattcaatggctatttgctattattaatactttataagtatgcagctattgatagagcatagagataagaagatttggtgaaaaatatactgatatcttctattgtattctcacaacacagaacacttctatgaccaaatgtggtggtagaggggtttccccacaaagcaagctattctccagtggataccaactgggtgtcctatagttgattcagttcacagtatctatctggagatagcatccgaacccacaggttaaggactcagtcccacaagaccacccttcccactcccccatttcatgtaccagtgcaagtcccagctttttacctgtgctctgccctactggctataaatcaaggttcccatgtaccccctccttgtgttcaatatttttctaggatggctcacagaactcagggaaacacttcacttatatttactggtttattatgtaacaaaattataaacaatacagatgaacagccagataaagagatacataaggtaaggtctggaagggttttgagcacaggagcttctgtcccagtcagttggtatgcaccctcctcctggcgtgtggctattttcaccaagtgagaacctcattaaatttcatgttcaagagttttatagcacttaagctccagcacctctcactttccttgaggtcagtgggtggggctgaaagttcaaaccctctagtcattcagtctttctggagaccaacactatcttgagactatctaggggccttgccctaagtcacctcatcatcataaactcaagtgagagcaaagggcttgttatgaataacaaaagacactgctatcacttaagaaattacaagaactccagaagctctgtacaaaaaccaaatattataatgaaagatgctcctatcacccttatcatttaggaaattaaaagggttttaggagctctgtgctaggaaccagagactaagaccaaaaatatatattccttattatgtagaagaaaaaaatacagaaatccagtttcaaaaaagcattgttcatcacccccttaaaaaggtcaataatgtttatttaaagtttattaaagttatgtgcacatatgcaagtaaatattcacaattcttctttgtgacccagaagctaattccctgtgctctttcacttgctgatattgttagcagaagaggatctccaaaacagtgcaaaagatgcttgccgccattggcttcctaacgctcatttgccaaaactctgctaatcaaaatagttcccagtgcccaaagtaaatctaaaagtaactcccaccaaggacccacgtttttagaggaaggtttgttgggaacatgtcattgccaaccttcacacaaggggaatcaatattctgtcatgttgatttcaaatcaagtatttatttaatgtgaccctcaggtaagtgcagaaatatgtgattgtgtgctggatttatttgatcaccttcagtaagaccctggtcaagtgactttctttctttgtgtctcaggattctcttcattaaaatgagcatttgtgaaatacagtataaatgatttagttttggatgtacagtgcagacccaggatggatggatggatggatggatggatggatggatggatggatggatggataggtaggtagatagatagatagatagatagatagatagatagatagatagatagatacacatatacactaagtaacaccacaccttgtttgctcagcaagtaatgccaggtgtagatgatacaacagaaagaaagccaggcaaacacagtgcccttcctctttatcaaagttcagtctagtcatcatgagtcttgtggattaccccagtcaaatcccaatgaacagatgatgttagaaccttttgttcaggtctataacatgtggcttattagaggaatctgattataaaggaaaaagcccttccaattaagtttgttttcttatttgggaacagatttgttcacaaaaatctaggagagaattcaacttttactgaattatttcaataatttattgaataaaaatgctctaatgttttatttatcttgatctataccaggataatcatataactgacgatttttctaaattctatattctcatataatgaataaaggaaaacataggtaagtgagttggtatctgaaatctatttcaaaaagtaacctgcagaggatatggcatgatcattcataaaacagattaaacccaatttccaattccttctacatctgttataattctggaaattcttttataaacatgaaatagaaggtactacaagactctgaaattctgagttatccagtattctattatatccagcataatttgagtgttaaaagtgttttggtaatattacaaagctttaagtggttttttttaaattacctatgtttcccaaatatactgatttaaaaaaaaggagggttatgtataggataatagtgtatttttttcaccatactatttcacttactgtcagattaattttatgcaattttaaaaatgaagtcattttattatattgtaatctttgaatgtgtatacagtaaatttaattaaatgaaaattgttaaacaaccgtgacaacctttcccccagctattcagaataattatgagttaactatatgttttcaaagggcttttaaaattattcctgtaaagcaattaattccaaataacatttttgttggctataaaatgatttttaaaatatttctacttgtagtacttgtagtgctaaaattaatcccataaggaactgtggaaagcagtcaaatgtgtaaaatttcaaagttcataatcttagcattagtcagcacttggcttttcgcactagcattaacttaggcaatttagagtactatcctaaaattatcattatcatttctagcattgggagtaaataacgatttttagacactacataattagtatgaaaaatcaaaaatcgatgcatgatcaaacataaattatgtgccaaataaaactactataatctatcaatgcaactagttaaatatgattgtcagtgatcccaaaacactcaaaatacaatcatcattatcttcagaaagtatcagagtacaattggaataaaataagagaaatgttaatgtatgtgtaagagaacatccaagcaatgtgactaaattttttgaataattaaatttttacacattttaaataaaattatgtaactcacgataattttactataaagttaattgttctttttacctaatcaaagtagttttacaacataaaaggtctttttcagagaaatgccaaaagcacgttcttaattaaaatgatttttaattagttcaaaacagaacttaaaaaaaatttagacagaactactacaaatcagggaaaagcaggtagaagtttatggaaaaatcctagtatgtttccactaattccatcccttatctcctactaattatgagggtatgtattttcacataaagattatctgtgctataattagtggtgttcccaggctgcctcactacaacgcttcttcccgcaattggtcagaacagaatatcagagaaagctctagtctgggcagacaggcaaatcattcattctctgatataagaactaataatcaatctgaggatgattcttgcccaagaacctacctcactgatttataatagaaaccaaatgaaaatatacatataaactgtttttataaacttccacccactataagaataagtgtcattatgatgattgtcacccatgcccacaagcttagcccagttccagatcctaaacacccatttccatactctaatgatagagactgcatagtctatctggagggaattaagggagccttagctaggtaactcagctgtctttaatgttgtttctaaaaccaacccacctcccactggagttgctttctgccttactctctcttgccatcttagaagatctcacctgaatttatagctcaaaaccccctgacacttcaatacctctcacattctgcctggctatcttactgatcgtcatactctctagatttttggcttaatattaataaatagttcagtcatttagctgatttagactcaatgtaacaaattcttttctaaccacgattatctacaaatagagcaagctgccttaagagttctgtatcatttgagatagacaagacacagctacatattcattggccatgattactgtaaaagacactgctgctctgtttgcaagattagacaagatcactgtacgatactaatcaccagcttcaccactgaaccactctgattctctgatgcttctggagttacagttctgaagacatcattatggttcctgacatcattacatcttatcaaactaaaaaaattattcctgtagaatccaaaataaatagaatcttattagaaaattatttgtgatttcagttaaatgaaatgtactccagaaacacaaatgatctgtgtgtctagatgttaaaactattactgcactaacatcttcattaaagacagtaggttttgttatttcatacagaaatggaaagataaaaaggctaggaaaatcagccattttctatagtatcatagaatttaagttactgtatatggtatgctaagatgttttattttctttcctaaaactgaagctaaacataaaacaatactatgaaacaatcataaaaggaaaaggaaaaaggaggaacttaatgttaaaataaatttaactttatttaccaaatccacagaaacttttcctataagtattataaagtgactgtcaaacttttgcatcatgttttactttagtttataagattgatttatcttatatcacatatcttgtatcttataaagtacatcttcataattagacatagaaaatgatatcattaactctgaaaaagagggttctttttttttaaatcacatatggtaagtcatatggtttggctgtgtccccacccaaatctcatcttgaatgcccaagtattgtagaagggttctggtgggaggtaattgcgtaatgggggcacatctttcccgtgctgttcttgtgatggtacataagtctcataagatctgatggtgctataggggggagtttccctgcacaggctctctctttttgcctgctgccatccatgtaagatgtgacttcctcctccttgccttctgccatgattgtgaggcttccccagccacgtggaactgtaaatccactaaaccctttttccttataaattacccagtctcaggtatgtctttattagtagcatgaaaacagactaatacagtaagccatgtcccaaaacaaatatccataaagaatatggtagttctaattataatttatgttagtatattgttttcaatttgaaatcaaaagctctttatactgtgtctataaatcaatcttataaactaaagtaaaacatgatgcaaaagtttgacagtcactttataatacttataggaaaagtttctgtggatttggtaaacaaagttaaatttattttaacattaagttcctcctttttccttttccttttatgattgtttcatagtattgttttatgtttagcttcagttttaggaaagaaaataaaacatcttagcataccatatacagtaacttaaattctatgatactatagaaaatggctgattttcctagcctttttatctttccatttctgtatgaaataacaaaacccactgatttgggcatttgtgatccactatgctaaaaagccctgttgtttcttggtcttttttatttcatgactattgtgagtcagatggaaaataggataaagacatgagaattactgagcagaacaatgggtttgagttataaaactgaacagttaggaggggcagggaaataaggacagagaaggtggaatggagacagggaaaaaagcagtgagcatgttcagaagacagtttgccagtgtagtcacaatttaccaagaatcactatagacaatgtcaagggttagcccaatttacattcaagcatttatcctttgtgttacaaacaatttaattattctcttttagttatattaaaatgtgcaggtaaattattattggctgtagtcaccctgttgggaaattacatactagatgtcactcatctaagccttgtttttaaagttaaaatctcagatgattctcccctgtgttttctgattcactgtcctatactctaaatggccatcaactcaggaatagagattattcagcctccaagaactacctaatggagcagtttcctccattggtagttattccaataagttactactcattttggttttcattccattacagttttttgatatgattatttgagcctaaaaatgtaacgtaatttggttcctaagagtttattaacagaagacaagttttaacttatgatgaacagtaggtgctgagaattagtctgtgttacttaaaaatttgaattgaattgtatctcatttagaatgagggatttgtgaaagccaaatatattcacattgtctataaaaagtgtgagtggctgaatgattactcaagaaacatgatccatagtggcaacaagtataattgctgttcataagactttgcttttctataaagtgttatgtgacctgtcttacctacagtttctttcaccttatttgcatttatatatgctccctaaaaatacagatgatgtaaatttctctaagttcttattagttataaatctgaattagaacaaaaataacaagcattcctgctactgaagaagtcataagacttatttaaaagtatgattttctgggcagagtgtaaataaggtggatttattctatatattgctgtactcttttatttcaaatatagtaatgcataaagtttaaaattaaatgtgccttccatgtagattaatactatccatttcatctttgtcaagtagaagtaattgcttggttcaatacaatccagtcccatccgagtagatctctttgttctttttcagaaatgggagagattgagagtttaaaaagcattcatcatcaggagaatttgttttaaaagcttccaagctcccaaacagccagtagataaattacccactattcagagaaagagagcacaattagttttacattatactaaaacaatcagctccataagtgactatgtttcttaagaaaaaagcaatatgaatgtcatagtttgtcctctttctcccaggctttacagccaacagcaagccttttctcatactagaagttttatggaaagctttgtgaatatgttttgacattgtttttagataaggagaaatatattcatgacttgtaaccatgtggttaataatacctacttcacaatgcaaagttaatgagtcttttgttttattcaaatgctttgaagctttatggtaagaaggaagacttcaataaattattttcaaatctacctttctttccccaataattatttttatgtaattatttacaactaagaagcaaaggaaggtgtaagaaaaaattatactgggggtaatgaattatgcacaaaaaatctacaggttgtttttttcatcttaacaaaatacatagttgctaaacagtcattacctcttttgacacatgcaggatggtgtaagaatgtactaaattcatgtcaactgccatgacttaacctggagaaacaccatgactagtaagctttacatacacagctgctacagtatttttagcattttccatttataataagaaagtgatcaatggaggccttagaggaaagagtgcaattgcaatcatataaatagccttatttccttttttgcacacaagtggtatctatcaaaattcaaacattgtaatacctattttcatatatcagtgttcatctatgggttacttttattttattttttaagttattcattctcataatgataattgatcattgttgatatgtgcatgcaggtcatatacaaaacttcctttacaccacacaaaaagtagtctacttatgttgtataataagttcgaacctttgtgccttaagtacaaaactgactcttctcatgcacataaacacaacctggaactgcatgacaaacacatttgaataaagctttcatttttcaaaattcatatatatgtgatcagtgtacagtatgaattgggtaaggagaaagagagggaagagaaaaggaaaaaggcagtgaaggagagaaatagagagaaagagaatatatcaaaatacagtgtcaaaatgtcttattcatgaaagcttctttcctagggatataagtttttaaatgtgtctgactatagaaaagactattaagtgggtatgttttgttttagatcagtttattaaattttttttcatgttagacaggtaatgtgccaatatcataacaagatttgagggaggcacatctcacacatgagtgtgaaaattcaatcatcacattcactgagtctctttcaaccagtagtcttagccaggcatgaaatctggggggctgcaaacctccaaagaaattctcaccacccatttgccacactcagtctttttcataatctttgtatcatggacttcaaagctttaataaataaagtcaagttacctaattctctggctacttataaaaggtcaacatgtcccatcccatctgataccttgatttgcatgtctttgactcttaagacatacacagattttctatctaacccctaagacctttgaagttgatgggataacagtaggtctaatattttttatctaaatataaagacctggaacttgataggattctaagataaatacataattttccccactgattgagtcttgcattattttgtcttcatattcaatttcaatcagttgttcaaccaattgaatttgggctcttacataatgcttcagactcatggttgcaccatgaagtctttcaatgtttctgattttcttcttttgcaaccaagattgtgaaatgcagatcaaagacctgtattggctttttctcctatcccagatgcataaggcttaggacagcactgttcaaagcctcgtagtaggggtatcctatggtcattcttgttaggggcacaacaaagattcacgagtaattgaaatctctttccctagtctagaactttaagtggttcctcctttgacttggacaagagctcaggttgaaaagtaattgctgacctcaggcaataaattagctggattaaaaaaaatcgtaacattccataaatgaaaataattatagatttgcctacaacaaaggacctaagaacctaccatcaaaattatttgtcctaaatatctaattcttcctttattcttcccctgatctaaccttaaaatctaacttacatatcagtatacgcatgctatcaacaataaaacacaaatctctgtattttaaaatttttttttattttctcagtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaacaa

SEQ ID NO: 2215 - DNA, 150903 bp, Homo sapiens
ctcagaaagaataaaacatctgttttaattggccagtaaaatacattgcaaatcattagtattttataaacagaaacattaagttataaatccatgttaaaaattgcagctcagtgcagccccaacagctgtgtgtccaaaagtctatttttacaacattttcctccagtatttttgtgacaagaaagttcctatctgccatctagatcaagagcctgaactacagtattttcaaacaagaaccgggagaagtcggtacaaggatacgtcgtgctgtgtatttaaacggcgcttcccacacacctgccgtctgcatcccgggaggacgccctttgggaaaggcctcctcggcagtgtgaggtctggaggggtctgcctggaccccatttttaggatgctcccctccccaataaaacagcagcccccgcccctgccctgcacagcatctgggggttcataacacaggtgcaatactgaccatgggccctggagggacgtctgcaccccgaagcccctgtacctcaaactcagagtttcttcccttctttgattttctggaggacctgcagctggccttcctgagacaggctccattcctgttccatttgccttcccggcagccttccctttagtgggtataggttttgacgttctgagttactttgtatcaaagagctaattaaaaatggtccttcaaaaacataaagaaaaacagcttgaaaaatgtacatttctatttttaaaatcttcaaacttccacggggggtggcaaatgttaattctgattttaaaccccattcaacagcaaaacgatgtgggcttcaactgtgggctccgcagacgcctggagaagctggagcccacacctttccctccaagggactctgtggacagaacccgtatcccccaagcaccaaggacatcctcagactgggacttctgtgtaattctgcacctcccagccataaaactgacccctcagccaggaatcaaacgaacctcgaaagtggaacagggaggccgcctcccatggctgcctggatggcaggcacagtgggagagtaatgctctgaacctcccaatgtgatgaagccgaaagccgaggcggggccagcaggcctcccgggcacagagccacagagcccagcgtcacacgcaccgtgcacgcaagacagacgtgcacgagactgacgcacacacggccggaggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgcatatacatgtgcagatgtggaatatgtagagtgtatggcacgtgtgcagaatgtgcacatctgcactgcaaagagtgtgctcatgtgtggggagcatgagctccagggacacagatctgtcccagtgctgggacactcagcaggcgtgggcacctcctccccacatgcacacctccctcataccatgtgtgtgcacctcctgccatgtgtgtccactacctccatgtgtgtgcacctcctcctacgtgcctaccacctccatgtgtgcatctcctcccacgtgtgtgcacctccttccacgtgtacctcctcccatgtgtgtgcacccctccgtgtgtacacctcccacgtgtgcacctgtgtgtgcacctctgtgtgcctcctgtgtgcacctcctcccatgtgtgtgcaccacctcccacgtgtgtgcacccctctcgcatgtgtgcacctcctctgtgtgtacctcctgccacgtgtgtgcacacctcctcccacgtgtgtgcacctcctcccacgtgtgtgcaccacctcctcccatgtgtgtgcacctcctgctgtgtgcgcctcctccatgtgtgccttctcccacatgtgcgcacctcctcccacgtgtgcaccttctgccatgtatgtgcacctcctccgtctgtgccttctcccacatgtgtgcacctcctgccatgtgtgtgcgcctcctccgtgtgtgtgcctcctcccacgtgtgcaccacctcctcccacgtgttcacctcctccgtgtgtgcacctcctgccatgtgtgtgcacctccacccatgtgtgtgcacctcctgccatgtgtgtgcatcttgtaccatgtgtgcctcgtgtgcgccttctactacaacaaacagcatcatgcttcgcgcattttcaacctgctggcttttggccatgaggttgatggacctgctgatatcaacgaggcaacatatttggaaggcaaatggggctgtctccccagaagggtgtcgagagggatctgatatgatgatgtcagaggtgaagtcacagcactcaggaggtgttgcaggctcagtcccctgagcaactcggtccaagtccgggccacagggacctgtcactctcctggagcctcaccactgcccttcccagaccagacccgcatggtggaaggaaggaggggttaagaaggaaggaagggaaggagggagaagaagggtggaggaggagagagggaggatcgaagggagggaggaccaaagagaggagtgagcaggaggatggaagtgaggaggaggctgtacagctacacagggctctagggcttacccgcccctgaatgagcccgtgtgggggcttctgccatggtggacctgggtacccactggatggagagagtgacacagacacatctgctcactccaggctaagagccagcctagcactttacatagtttaagtcaatcttccagcaactcatgagggtcttacaaccctctgttccatggagtgagggggagtggagcttagctaagcgccacctagcctgcagctggtgactaagctgaacgtactcaacctcgccacacctgcctcatgagacaagagtgggtttcgtccagagctggccctgctcccgggcaccatgggtggcctggagagatgccagagggtgtgccactgaaccaaggcagaacaagacctgggcctagagactgccagagcacgtgacaccagtatagcagagaggctgggaggaagcaggtcagggaggcagcccggacgctggctgggggcctggagagcaaaggcagcacctgctctgaaggagggaccagcagcgccgggccacgtccactgactaccgccaggtgccagcccggtgcaagtgggactctcctcccaggcggacacctgagcacgggcggccccacccgggagctccctgcagccccacccccactgcaatctcccgcccactacactggccgtccagggcaggcacgggagtggcactcactggcttccatatttcgtcttcttgaacttgtccctcttatactgggcgtgctcctgctccaaagccccaaccccagcgatgacttgctttagcgtcttgtaggtctcctgggggtcgtcaatgacgaacgtcgaatactcctcctgctccgggccgtcatacacagatttgctcccacaggcctctgtggagggcggaggggtcagcgcagggcaggagcccaggccaccggccccgtctccacacagctgcgtcgctgcaggccccacccacagtacacatccttccaacgcaagctcctccagaaagggctgaccaccactcgtaaacgcagacggagatagaaaccattcccgcaggtaggcgagttgtgcccacactgagcccagggaaagcccattgggagctggatgctgagcaacctcattcacctctgagggctctgctgcccctagctcccagccttgtcaccaatcagccattctcacagggggatgtgcacatctctgcacgccccaccagcccgcccagccagaaccaggaggagagacacctgcagctggacgctgggctggctcatgggccctggggcagccctgaagagtcagctgagggagtgagcacgatggggttcagcacatttcacacccagctgccactgagcatgtccagccaggacaggcctagcccagggctggccgagcacagggcggacaccagtctgtgccgcagcttctaaagaccactgccccggaccccacctacgcaccggggccaccttcctaatcggaccacatcactcctgctgaaggccattctggtgcctcgcccctagcggacagccatggaacccttgagccagggcagggccctgtgccacctgagtccaaacacctgaaccaggtacacgtctctgcctcactgctcacagcgcctgggcacgcactcccggagccagcaccgatgccctgcagctgtgtccatctggatggaatgaatgtttgtgcccccaaatctgtgggttgaaatcctaactctcaagggatggcatcaggagatgaggcctttgggaggtgacaaggcgtgagggtggaacccttgtgcaggggatgggcgtccctatagaagacaccaaggaagctggcttgcctcttccacatgtgaggacacaatgagacactggcgggctgcagcccagaagaggacccgcagttaaaccagcactgctacgcccggatctcaagcttctcaggccttcaatctgggaagtgaattcctgctgtctgtaaccacccagcctatggtacaatttttacggcagcccaaactcaccaagaacttggtactgagaagtggctgctgctgtaccttcaaatgtggactggctttggaactgggtgctgggcgaaggctgaaggggtttgggggtgcagagcggaaaaggcatggctgccatgaatgtccttaaaggacaatgctgggggctcgggagaggagagctgcagagaagtcctgtcttaggggatatctaagtaaccctgaacagaatggtggcatgagcatgggtggcaaggctgttctaacaacatctcagacagaaaggacggccatgctactggaccgtggagaaaaagccatcctcgtgacaaagtggacctgtgttcatgccctcgtgttctgggagggtggaactcgcgagtgatgacatcagacacgtaattgaggagatttctaagcaaaatgctgtgggagcggcttggttcctcctgaccgctgacagcaaaatgtggggagagagatgatttgaaggtggaattgttgagcaaaaaggaaccagaactcaaaggctggttgagttaaaagatttgagaattaaaattccagcctacccatatctcaaaaaaaatgagacagcatgtttggaagagaccattaagcaggtggctgtgtggctatctgataaggagacaagtgtggggctgagccttggacttgaccaaccatctcagcaacagccgggagcagagaaggaaccgcaccagcagaggcactgccagaagaaaccaggaaacagagaaaacaggatgaaatgaaggcaggctgcggtgtcttaagccctacaagccaggccatagagctattcagctgtgaacatgtgccattcttcaagacgagggaagaaggaccctgaagcgggtagggccatcagaatgccactctcacccagaatgagtccatggaccatgtatcagatgcaaaattctcagctggaatattgattaaaaaataaaactggcaataactagaaaaaaaatcgcaataaggaatctgtccacccagccatcactcacccatccgtccatccacccatctgtccatctacccattactcacccatccatccctccacccatcactcacccatccatccatccacccatgactcacccatctgtcgatccacccatcatcactcactcctcggtccatccacccatcactcacccctcagtccatccatcactcacccatctgtccatccatcactcacccatctgtccatccatccattactcacccatctgtccatccacccatcactcatccctcggtccatccacccatcactcaccctatccatccacccatcactcacccatccgtccacctacccatcactcacccatccgtccacccattcatcactcacccatctgtcaatccacccatcactcacccctttgtccatgaactcaacactcatccatctgtccatccacccatcactcacccatccgtccatccacccatcactcacccatccgtccatccacccattactcacccatccatccatccacccatcactcacccacccatccatccatccacccatcactcaccctttggtccatgaacctaacactcacccatctgtccatccacctatcactcacccatccatccatccaccatcactcacccatccttccatccacccatcactcatccatctgtctatccacccatcactcaccctgtccatccatccatcactcacccatctgtccatccacccattactcacccatccatccatccacccatcactgacccacccatccatccatccacccatcactcaccctttggtccatgaacctaacactcacccatctgcccatccacccatcactcaaccatctgttaatccacccatcactcgtccattgctccatccacccatcagtcacccattggtccatctgcccatcactcacccatctgtccatccacccatcactcgcccatctgtccatccacccatcactcaccctgtccgtacacccatcactcaccctgtccgtacacccatcactcacccatcggcccatccacccatcactcacccatctgtcagtccacccatcactcacccatctgtccatcaccatcactcacccatctgtcagtccaccgatcactcacccatctgtccatcaccatcactcacccatctgtccatccacccatcactcaaccctcggtccatcctctcatcactcaccctgtcctccacccatcactcacccatctgttcatccacccatctacccatccatccatccacccatctctcacccatctgtccatccacccatcactcacccatccgtccatccacccattactcacccatctgttcatccacccatcactcacccatccttccatccacccatctctcaccatctgtccatccacccatcactcacccatccgtccatccatcactcacccatccttccatccacccatctctcacccatccgtccatccacccgtcactcacccatctgtccatccaccatcactcacccatgcttccatccacccatcactcacccatccgtccatccaccatcactcacccatccttccatccacccatcactcatccatctatccacccatcactcaccccagtccatcctctcatcactcaccctgtccatccatccatcactcacccatctgtccatccacccatctacccatccatccatccatccacccgtcactcacccatccttccatccacccatctctcacccaaccgtccatccacccatctacccacccactcagctgcctgccccgccatctgtccagcacacccatccaggtgctaggcacttcctctgtgccaggcccaggaaggtcactgcatatggaagctgaggagatgggagatggttgtgactttggtgacacaggtgagcccaggtgatgtggtttggatttgtgtccccacccaaatctcaggtcagactgtaatccctagtgttggaggaggggcctggaggaaggagaggggatcatggggacagacttccccattgctgttctcgtgatagtgagttctcacgaggtctggttgtttggacgtgtgtggcatctacccccatctctctctcttgctcctgcatgtaggaggtgcctccttccttcctctttgccctcccaccatgatcgaaagtttcctgaggcctccccaaccatgcttcctgtacagcctgcagaactgtgagtcaatcaatcttcttttctttatagcaacatgagaactaatacaccaggctatggggatggtgaggttgggaagcgcctggaggaagacacttccaaggtaaacagggtctgccagcctgatgcgcaagggtgttcccagcagaggaagagctggagctgtgatgcggggcgcacggcctaggaggagctgagcaaggttggacagtggtgcagggagcaagctgatcatggagggcctggtcagcatctttcagaacctgggtcttgtgtgtgatgacctcaccctctccgaggctccctgactctggcctctgctgtgtcggttcctgctatgagagggctgggaagaggctggctgatgccagacccactgtcttggccaccctgaggccttgtgccatcttcacagtatccagggacctcagacccagggacagcacctcgcacacttgctgggggagaagacgctgtggtgggtggtggcccatgagtgtgtacatgtgtggttgtctgcacatgtgtgtgcatgcctgcacatgggcctgcacatgtgagcgtgttgtgttcaactgcacatgtgtgcaggtattgttgccttgcctgtctgcacacacatgtacctgtatgttcatttcacacatgtattgctgggaacatgtgtgtacatggctatgcatacatgtgtatgtgcctgtgtgttagtgtaggcctggaacccacgtacacccagggcatgtggggctggagaacaggcgtggccaagctcacagatgggcagctgcacggacacccagggcatgtggggctggagatcaggcgtggccaagctcacagatgggcagctgtgcggacacccagggcatgtggggctggagaacaggcgtggccaagctcacagatgggcagctgcacggacacccagggcatgtggggctggagatcaggcgtggccaagctcacagatgggcagctgtgcggacacccagggcatgcggggctggagaacaggcgtggccaagctcacagatgggcagctgcgcggacacccagggcgtgtggggctggagaacaggcgtggccaagctcacagatgggcagctgcatggacactcaggcaggactcatgtgtttccaggccaaggcacacttgacacttctgggttaaatcaggggaatgaaaagaagaaaatctaacaggcataactccaggcacattccgctctatttccattctgagtgggactcaagggccctgtcatatgatctccaagagcagatccgagttctaccagacactggcatagaaacaaacgcagctgcttcacccccgtgggcttttcttgtctctgcctctcctgaatcacagacctcaaaccactgtccccatgtggtctaactgggcttatctggattgctatttcaattctgtaaagcaattcaatgtcacagataatgatacatactgcatatagatttgaaacacacggtgtgcctggcactgtttcaaatatatatgcagtatcgttatctgtgacattgaattgctttacagaattagatggcatgtgtgtacccacatatatgcatgctgacacatgtgcccaaagacatacatgcatactcacacgtgccctcatgtttccacacatgcacaaattcatgcatgctcacgtgtccccacacacacatgctcacacatgtacccacacattcactctcatacatgtcatgtccatacattcacacacactcacacacgtccattcatgcactcacacgtgtccacacattcacacatgctcacacatgtccacattcacacatccacactcatacatgtcatgtccacacattcacacacgctcacacatgtccacattcacacgctcacacatgcctacacatatgcacacatctcatacgtgtgtccgcacacatgcaagcacactcacatacgtgtccacacacatgcacttatccctctggaaaacaaaggaatgaaaaaataggtcctctaaagaaacttggcagtacagaggttacaagttaaattccatctaaaaattatctatagaacctattatacaggtaattgtcccccagatagctgcctaccctgcaaaaagcttttcgcatccatccgtgctacaaagacaactacatgtagcccacactacaccagaggctcagaccacaggttttcaccccacagcatgctcctgaggccggggcctcgccagccatcccctcgctgcacagatctgtgtgccgggcagactcaccctgcatcttctccagcttgctcatgtacaagttgaagagggagtagatacgctccgtctcacggtccccatcaatgtccagctggatgttggctgggaggccgctgtccagacacagcaagaacagaaagataaaaacacttatttaaacgatgcttttaataatgacattcatttttaaaatgtcactgaagaaagacaacgattgtgttggaagtgaaattcgacaggatcgatttgctgtccgtctgtgcacagccggtgtgttggcttgctgagcaaggctgacagcgtccacagcagcacggacagcagtgtcaccaggctgcaaaccggaactaactagcaacctctgcttcagttaccattggcctatttggacacgtggcaaaagatccttgctgtttagtatttaaaatgtgcttatcatttgtactaactgacctttcctgaaatcacgcagtactgagttatgtcttgtttaaatctattcctactccagaatcttatcaatacataagaaatttaggaagactaggtgctaaaatccccagtgtaatatgtaatacttgtacatttttagtatcatacagaactcaattcccaggaactatgaacactccagacctcatgtggtttattccttcagtcatttcaaacacagaaggaggctgtgtgcttgtttccctgctcattctatgtctgcttctcctatgttcacaccagcacacgtcaggctggagcgcggtggcacgatctcagctcactgaaacctacgctttctgggtttaagcgattctcttgcctcagcctcctgagtagctgggattataggcacacaccaccacgcctggctaatttttgtatttttagtagagatggggtttcaccatgttggccaggctggtcttgaactcctgagctcaggtgatccacccacctcgacctcccaaagtgctaggattacaggcgtgagccactgagcccggcctcatgtctttttataaatcttactttgtgttattatgaaaaacctccatagccgggtgtggtggctcacacctgtagtccccacacttttgggaggccgaggcaggtggatcatctgaagtcaggagttcaagaccatcctggccaacatggtgagaccctgtctctattaaaaatacaaaaattagccaggtgtggtggtgcacacctataatcccagctgcctgggaggctgaggcaggagaatcgcttgaacctggaaggtggaggttgcagtgagccgaaatcacaccactgcacttcagcctgggcaacagagcgagactctgcctaaaaaaaaaaaaaaaaaaaaaaaaagaaaagaaaagaaaatctacattgtacagaagcacgtctttgatggcttcagacaaagtggcctcacggttaatttcacatttgcacgcaggtgcaaccaacagggagggcctgataggaacgcgcggggctgttatttttagcaaaatgctgccttgtgcagaacgtgtgaaatatgctctttaatttagtaaatactttttaaaaggcagaaatgcttattatagctaaaacaattcttaaatcataaaatttctgaaacgtctgtaattttttccatactgattagaaattgtttccaacttatttttgtttgaagtatgacagtttttcccttttcttcccaacttctcttgtaaaaaaagaagtgggtttctgctaatgaactgatcagatgtcaatactgtatatgccttttgagctgagtagctcagtatttggatacttggtcatttgttttattaggtaattgataaaattgtgtcacttattcatgttcaaccatatatttatgctgtctggggatgggtggttatagttctgtgtgagaaataatttgtcagtcttcaacagcttgtaaaaactttgcagtgagagcttaaacatctaaataaataatgaaatgcatttatcataaaaaaaagaagaaagaagatgaagtgaccaacattaaaacacatccctggccagtcagggagttcatgtgggtaatcccagcactctgggaggccgaggcaagaaggatcgcttgagcccaggagtttgagcaacaccaccctgggcaacatggagagaccctcacagtgagacctggcaacatagtgagaccccgtctctacaaaaaaccaaaatttaatgagctgggctggtggcatcagcctgtaatcccagctacttgggagagtgaagtgggaggactgcttgagcccagaagtttgagaccagtctgggcaacgtggtgaaaccccgtttctacaaaaaaccttaaaacaattagcctggaatggtggagcacacctgtagtcccaggtacctgggaggctgaggtgggaggatggcttgagcctaggaggtcgaggctgcagtgagctgagattgcaccactgtactccagcccgggtgacagaacgagatcccatctcaaagacataaaactaaaaaagcatccccgagctgggagaactgaggctggctgtgggtgtgcgggataggggaggctcccgagctgtccggcctcagcggctggagcctcttgggacccacagatctgccaaggcagtgagcaaactcggcagacgtgttctcatggagataaatggcctggaaggaagcctcctgggactgtgttccctgcacggtcggctgcgggtggggacaggccaggttttctctcctcgtcaggctgcaatgcttcccgctgtcctgggatgcgaggacatgggagagcgctggcctctcctgggggattctggggcggtggccacgcatgcctgagcagcagccaggcccccttcctgagcttcagcctctgtgtccacgaagcaggatctaaggtcccacctctgaggctgtgggaggattaaacggtggcccagcatggagcacagctcatcccctgcagggcccttatgcgaaagcatcacgtggccacaacaacagcgaggtgcatctcacggagcataaccagggggaccgccaggcacccaggcctcctccttaggaccggcagatatgacccaagcctctgtgcaactgccagaggcccggctgatggggggccctgctgatggggggcctgacagggggcccagctgacggggggcccagctgacggaggacccagctgatgggggcccggctgatggggggctggctgacggaggacccagctgatggggggcccggctgacgggggcccggctgacgggggcccggctgacggggggcccggctgacggggggtccggctgatgggggtccggctgacggggggcccggctgacggggggcccggctgacggggggcccggctgatggggaggcccggctgatggggaggcccggctgatgggggacccggctgatggggggcccggctaatgggggggcccggctaatggggggcccggctgatgggggacccggctgatggggaggcccggctgatggggaggcccggctgatgggggacccggctgatgggggggcccggctgatgggggggcccggctgatggggggcccggctgatggggggcccggctgatggggacccggctgatggggggccgggaagacaacgggctgctgcgtcatgtggaatcaaggtgggtgtcctgggccagacgaagctttcagggaggggcttgctcccagcctcctcctagagaagcaggatggccacggcctggggagtcccccttcaccctgacctcccgctcccccggggcagggcctcaggaagaccctcgaaggcctgtggcaccctggagtctgcgcagagccttccagaggctgggccccagatgctccctcgagggaggacccctcgggtgggaggctcctgggaggaggcgagggcagccctgtttatgtgcagcttacaggcaggcatgcactgtctgctggtccctccctactcagccccttggccacatttcctgcacagtgcacgagctgggcaccgaggcacagacctacccagtgcagggcgagcagcccggagccgagtcggatggcgccctacagcacagccagtggccgctcaggtaggcggacgggtggtagacggtgaggcgcttctggttgcactggctcactttggtgagaatgtcgatccagtccttggcctccacgcagttgttggcctggatgtacagcgcacgctctggctggatgacctggaacatctgaggacacaggtgggctcaggacagcgcacatgaggtctcgtggctgagcacgtgcaagagtccaccaggcacctggccgtcctcgccggagtcgtaagaggggacgctgagggtgcacaggcccaaaagtcctggagctctaagccccagaagaggccaaggccagggggtgcatggagctctctgccaccctaaaacctgacagctggggccgtggggaatggaggtgagaactggtgcagctggagatgtggccaggtggccaggaacagcttggccaaggccctttatgtcctggagccttggaggtctccattcaagacaaaagaggggccctgtggcctccccacaaggccctcctgcagctgactgcaggcatcccatccacgtggtgctcgtgctgtgtcagcccaggtggcccggcctgctcagctccttccccaactgaccagcccaggattcttcctcctcctcccagctggggttagggggctgcttcctcttgaagcgtctcggggcagcaacaacctttaccatttattactcattcaacaaacatgactgagcaccagcactctcctatgtcccggagacaaagcctggcatagagtttctactgaacctgcagccaccaagaaagactaaacgagggcaggtgtcagcagaagctggaagtgagcagtcctggtgctgtagtcggcgttgactcaaagttagttaagcagggggtgggggcaaagggtgtcaaaggcagaagaaatgggaggcacaaaggtcctggggcaggtgggacaggggtcctgtgattggagggacaggtctcccggggcaggagtgacagaagccttaggattagagggacgggggtgctggggcaggggggacagatatcctaggattggaggtcagaagctcccagaaggagccggctctgttgcacacagaagacaggttttctgagtaggagactgactggaggttgggagggctctcatgtgggacttgcccttaagtcaggagtcagggggacagtggccttctctaggggacgggccttctgcactcatctggggaggatttgggctccaggtttctggtgaacagctgaggtcttatttacagaggccaggagcctcccgccttgcacccggcacatgtgtataggtctcggactggacgcccccgtgcatggctgtgatcccccatggagggcgtcctggccatcatcccaggctcggccctgccaccaggagcagccttcagaaaggtctccccagctggtgagagcctggcctggcagtggcctcaggggaatcgggctctgaggaagtcagtgggaatgaacagctgggaacaggcggctgaaactagggaattattgggaatctatgtgaagggctggaggtgcttccaggacatgtccacactgcttccttcgagggacggtctcagggccaggttccggccatccccctcagtcagcaggcattgagcccacaccctcctcttcccatctccccctcttcccaacccttctcttcccagccctcctcttcccagccctcctcttcccatgccctcctcttcaaattactctccaaacttatgccttttgcaggatctgtctggactgcctgtgaataacatgctagtaaaattctgccaatggtaaggaacatgcgtcaactttggcacgaggcccagggactgtgccttccctgcaactgttctatgaccctcatgctgcagtcggggcacagaaggcttgtcccagccagcatgtgtcagggtacggggtcagcctcaggatggcacggacggcggggtcactggctgaaggggcactgagtcaccagggagaacgtggccagcggccgactctgggaggccaccacacaatggtgacgccacggacacctctaggggattcccgccagaaatgcatcatcagaacctgccacgtcggcacatccgacaaacccacagggagggatgtccagaaaaccgaaggcctgcacgcctcaaagatgccaaggccaccacacacaaagaaaggctgggagtgtccagtgggccagacggagggggcagcagaatgcagcgcagactggatccagaggggaaggaaccacagccggaagaacgggactggacagcggcaaactcgaatgtggtcgcgccggcgacgtgcgatggtggctgctgtggttttggggactgcacggtgggaaacacacttggaagtgttgatacattcagaaaagcacgggcgggaccgtgaagggagaaggaacaagtgtgactggggaacgaggcgacatgtgggtccgggtcaagcgtgaccggggaacgaggccacacgtgggcccgggtcaagcgtgaccggggaacgaggccacacacgggtctgggtcaagggtgtgtggaaagtacttgttctactcgtgcaacttctataaattcaaaattatatcaaaataaaaaagcttccaaaaggaattccagacggtcccaagcctgcttctgggatgtctttgacagagggccccttgacattggggaccctgcgggggacgccacctgaagcagctcaggccccaccttccggcaggttccaccccaccccggtgaccccgggcacagagagtgtggctgctttgatgcgagattccgacacaaactcaccagcacctggtgaacaacccgagtaacacgaagactctgagaagcctggagtgcagtgggtggggaagggtgagcccagggccaggtacgggaagagagcagagaaaacctggccaggcctcaacccgaaagagaggcttgggggccccacactcacgtttttcattttgaaagactcctcctccagcttctccactgccaggatgttctcgatgggaatgctgtagagaggctggtcccctgcagcagagatggactgtcagtgggtgcgggccccgctgtcccggctggggtccgggtggggctgaggggtctctgccggggggtctcccagggggtctttaccggggggtctctgccagggggtctctaccggggggtctctgccagggggtctctgccagggggtctctaccgggggtctctgctgggggggtctctgccagggggtctctgccaggggtctctaccgggggtctctaccggggggggtctctgccagggggtctctgctggggggtctctgctgggggggggtctctgctgggggggtctctgtcaggggatctctaccggggggtctctgctggagggtctctgctagagggtctctgctggggggttctctgctgggggggggtctctgccaggagggtctctgctgggcggtctctgttggggtggtctctgccaggagggtctctgctggggggggtctctgttgggggtgtctctgctgggggtctctgccagctgggggtctctgctggggtgccctgggccggaggaggtgccccatgttcatctccttggggatgatggctgaatcactgacaggctgcaggtgcgggggctgaggaagcctgggacccacctggccctgccatgcacccaggctgggcccaatgctcgcatcctcacagctgccgtggcctcaggctctgtccccagaacatgttcccgttctgggacatgaacatgggagaaactgctagatatttcctaatctagatctgagccagcagatctgacagcgaggggcaggaggtggtgggaagccccgtctacctcggcggagcggcaccctggccatgacgaggcgaccagaggaggaagggacgtggacagaaaagcaccttactgatgtggtcagctctgcgtttactggttctctggggaagcagatttccctcactttccagcagcaggtctgaaagaccccttcagggatctttgaagggagaaccagaagcagagggctctgggtcaccgcggccccgggctctgcccgcagcactgaatccttcctcccctcagctctccccctgaaaaagcagactcagtcccagggcccagcacgctccagcaagagccagggaaagcgaccttgctccttacctttgcttttgtggtaggtaaattcatggttggtcaagcgaaaccatctcttcttaaaattcttcatcccaaagcgcttccgtccttgggccctcttgatcatgaacctgtgtgaagagcacacagggccggggtccgggcctcagctgcctccctgcacaggtgaaaaaccacaccccccactttctgcgttctgagacctgaggcaggcagtggattttcaatatcttatcattttactccgagtgatgagattaaaattggaaggcaatgcctctcctttgaaaagttgagcgctgactgctttgagtcaccagttggtgatggcaccaggttttaggagatctccaaccctcctgcctcccacactgaactttcaacagtggtgctgccactggaaatgccaatgcgatgctcccacggcggacctgcggccgtgggctcagggtcagggagggcagcggacgcccacacaacacggaggacctgcggccgcggacctgggatcagggtgggcagtggacgcccacacaacatggaggacccgcggccgcgggctcggggtcagggcgggcagtggacgctcacacacagaggacctacggccgcgggctcggggtcagggtgggcagtggacactcacgcaacatggaggacctacaggcgcgggctcggggtcagggcaggcagtggacgctcacacacagaggacctacagccgcgggctcagggtcagggcggacagtggatgcccacacaacacagaggacctacggccacaggctcggggtcagggcgggcagtggatgcccacacaacacggaggacctgcggccgtgggctcggggtcagggcaggcagcggacgctcacacacggaggacctgcggccgcgggctcggggtcagagcgggcagcagacgcccatactcagaggacctgcagccacaggcttggggccggggcaggcagcagacgcccacaaaacccacacctgtgttgtgcgggagtcacgcaccagcgcctctgccagaccaaacctgccccctcagggccagccctgctgtggtagaaggcgccactgggccacgtcctcaggaaacgtggggagcaggagacaggatggccaccgaggatgcaaggcctcagcgaggaggacctcaagccttgccctgggcagggtcctcgaacaccctcccggcagcccagggccctctgaggctcggccttcattgccgggcaggggtccctgaccagaaccggcggccgagctggaggagaagaaagtggccagacagagtgactggaggacagaggtggaagctgaggacgagaagccaagctggagagacagagtggggaggtgggcgggggagacgcacctcgacaagcgcactcagaaatcggaaagaggggctttgagcagcaacacagccagatgtggccagagagctgtggacgcacaccggagggtgtggaagctgctgggagctgttcaagagagaaaagggcggggcgctgggagccgccaggacagcgcagttcacaaccagtggatgccgaacgccgttcattccagggattcacaggcaggaagtcagcccaggaggctgttgaggaccagcaggacccagtgggatgcgcagggcggggcctacacagacgggggttggggggggactgggagctccacgacatgccggcctccttgagggcaacagggcgcctctgagaagactctggaccatgtagcagttagatttgagtagcagtcttgttataaatgttttcggctttaggatttttttaagaaccccaactttctgagggccttcagtggatgaggctgcatgtgaattttatgtgcagtttccaggttaaggcagcactgagtggagagaagccagtggctcctcactgcacagctctggtctgggcgcctggctctccaggagtcggttttctaaccgggcccatcgcgcgtgtgggacggggaggcaggagccacggctaagccggaagcctcaggctgaaagcagctcggccccgcgcagccacggccaactcaactcagcaaacacacgctgcgctgcagaggccccgtccccagtcctgtgtcccagtgggtgaggacacacacagccctgagagacggcagaggtgtgggagcatctcagcacagggtgagccctcaggaaacatggtcatcaccacccccacacatggacgaacatggcaagacacacttggcaccaagggctgagatggcagaaccgaggccctaggacggcccatgcttgcacaaccgagggtggccctaggtttggggatgtgacagagctgaggtgccggaggagaagctgatccaggggctggaaactcgagggcctgatggaccaaaaccttggtgtgagtcgcaggtggtgcagctgctggaaggagctggtggagcctcagctgcatccagggcacctgggaggcgcctgtccttgaacctctggctggtggcacctgggaggcgcctgtccttgaacctgtatctacagcagcttctcggcgtcagacacacaagccctgagtgtcctgtgttgctttagggattacaggatgaatatctgttgctttgaaagctgtgaatttatgaaatgtagaaagtaaaaagtttcctcttcaaagtttcccttcttgttaaagaataaatcataagtgttagaaataatagtttcttttaaagactaacttccttcaagcctccttgctttgtgctaataactctttgttaagctctatcctgtgtagctgttggacgtgcccacaggctcgtaatatattctgtgtccttgtaccttaaccaaggcaattgtgttagacgtactcataggcatgtcccagctcacagcctatgccccttccttatttaaacatattattatttttctacctatttaaaaaagttttaaattattagccaatcaggtcttaatttagattgtgaggtccggctccaggcaatggggacaggacacgacaacaggaacctcgtgcgtaaggaataaatattctggcgtctctttattctgtgtgtgcccttgccattactccttctgccagggacaccctttctgcagaaagtaaaaattgcctcgctgaaagaactttttgtctaaatgctaatttttccttatggcaccgaagaacaaacattttgcatttctaacatgaaatgtgtgtattgcaaatgttattggttaatatatgattaagttaaatgaaggtgattttaagaaaaatagcaatgtaagtaatgccactggggtatggtccaccagtgacccagagatgatccaggtttcagcagatggctctaacagagtatccacaaaaatagacaaatgggacttaattaaactaaacagcttctgcacagcaaaataaataaccaacagagcaaacagacgacctgcagaatgggaggatatttgcaaagcacagatccaacaggggactaacagccacaatttagaaggaactcaaacaacttaacaaaaaaaataaaaattaaaaaaaaatttaaaagtggccaaaggacagggggatagacgtttttcagaagacaaatggccaacaagcatacgatataaagcccagcgtggctcatcacctgaggaatgagagccagagctgcctgtgaccccacctcacgccaggcagaacgaagccacctgcgaccccagctcacgccaggcagaatggagccgcctgaacccagctcacgccgggcagaatggctgggatcaaataaaacacggaaaaatgacagacgctgcagagctgtggaggacgtgagcgcttgcacgctgtggggaatggaaattagcgcttaaggaaacccacggagatttctcaagaagctaaaggcagagctgccattcgatccagcaatcccacaccaggccccacccaaaggaagagcaattaccaaaaagacacctgcatgcgtacgtttaccgctgaaccactcacaacagcaaagacacggaatccacgtgtccaccaacggacgactggataaagaaaacgtggcataaatacaccacgacatgctactccaccatcaagaggaaggaaatcttatgttttccagcaacgtgaacggaactagaggttgttatcttaagggagatgactcagagacgaaaagccaaacgccccatgttctcactggtccataggagataaacacggaggggcggggcgctctgggacacgtattcggaatcacagactgaggcctcggaagggtggaggtgggagcgggagaggaatgagaaattactcagtgggcacaaagtgcccgttcaggtgacggtttcacgagaagccccatccaatacaactgcacttgtgcccgacatgttggcaaacacataaaaaatacaggaacatggtccacaccaggcagagcaaagccccgagcgggagtgggagccgggccacaggacggggttggtggaaacgggcagacgtgtcagttatgtaaggaaggttgatgggctctgatgctccagggacctctgggtggaggttgagggaggacaggcctgtgtcagaaacacggggtggctgtgggacacagacgtccccctccaaggtcaccgagaaggtggcagaggggtcccaggctgaaggcgcaggggccagacccccagggctgtcccctctgactctggttccctgagcaaagagccctcgggagcctggagggaaggccagccccaagtgcgggtgtggacaacacggccagtggtacagaaatcacaaggctgctggccagcaagggaggaggctgcccccgactagggaatcttctggaatgtgctgggtgctctggggactgggggcccccatccctttctcccctccggccctgccggatgccaccttacccttctcccccctcctgccctgccggacaccaccttacccttctcccctcctgccctgccggacgccaccttacccttctcccctcctgccctgccggacaccaccttacccttctcccccctcctgccctgccggacgccaccttacccttctccccactcctgccctgctggatgccaccttacccttctcccctcctgccctgccggacgccaccttacccttctcccctcctgccctgccggacgccaccttacccttctcccccctcctgccctgccggacgccaccttacccttctcccctcctgccctgccggacgccaccttacccttctccccactcctgccctgctggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgccggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgctggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgctggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctccccactcctgccctgccggacaccaccttacccttctccccactcctgccctgccggatgccaccttacccttctcccctcctgccctgctggacaccaccttacccttctccccactcctgccctgccggacaccaccttacccttctcccctcctgccctgccggacgccaccttacccttctcccctcctgccctgccggacgccaccttacccttctcccccctcctgccctgccgcccccctcctgccctgccggacaccaccttacccttctcccctcctgccctgccggacgccaccttacccttctcccccctcctgccctgccggacgccaccttacccttctcccctcctgccctgctggacgccaccttacccttctcccctcctgccctgccggacaccaccttacccttctcccctcctgccctgctggacaccaccttacccttctcccctcctgccctgccagacgccaccttaccctccttacccttctttaagcacgatgggctgctcaacactcttggggtctcttctccccgaggacgaaatcagatccaagaactaaagttggaagaaatcaggtcaccgggaggaagccacacatctgacgtgcacggctctctgtataacaacagcgtcggcggctactgcctcctttgtaataccagtggagacagaatctgggcaagtgagtccttccccgagggctgtggggcctctgctccccactgtgccaccccagccccggcactgccacagagatctcaggtgagaggccgggctcaggcaacacctggggatcaacctgcatctccagaggccacccaggggtgactctaagcagggaatctgggtcccggtagtgaggaggctcaggcatccctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgaccgtggggaggagcagagccctgcggtctggatgttccccacacaccgcgttcctgaccgtggggaggagcagagccctgcggtctggacgttccccacgcaccgcgttcctgactgtggggaggagcagagccctgcggtctggacgttccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgtggtctggatgttccccacgcactgcgttcctgactgtggggaggagcagagccctgcggtctggatgttccccacgcaccgcgttcctaactgtggggaggagcagagccctgcggtctggatgttccccacgcaccgcgttcctgacactgagtctgcagccccagggctccacgactgcagcctagagtgagtccggccaccacacacactgaggtgggacgcgccctcattcggggggctcagacacagaacaagatgggcgagggccccgttttggccccaaaggcagtcacgccaaagagtttaccaactgtgggaggaggtgtcccaggacttgggacaaggctgtctggacagcgctgtgaatgcaccgaacgcctttattgtttaaaatcgctaatggccaagtctgtgtcatgtgggttctatctcaattttaaaagagaactccgtctcctgagcacggcacacgggcggtcggagggtgagtcgatacttacgttcttcaccgcatcagcatatttctgctcattgaagaattcataaaatgtagccatgtaggactccttaaaactcgcctaaaatgaaacggagatcactcgaggacagcccgaagtacctcggctcacggcccaaatctgaaaaagctagaggcaagaactgtccaagcctaaatgacgataaacaggcaaagaacccggtgttaccgggcaagtgagagcccgcagggctgcccggaggacgaatcacataaatcgctcaggcgccaacgaagaccatcagacctgccagtgcccgtgaggtctccaagcaccctttggcatcagtgactccgtcctggccccgggctgtccctcacacctgggtcccaggctcatgaagaggtacgttggggcccagatgtggctgcctgggaacctggagtcataggccagggtcccagagcccccacgcccatctctcgcccgtggggcataagggccgctctgaggtgggaagagggggcagggacctccatcacacggggaagtggaggcacccagggattcgggggggcctttgcagccaccattcctgaggctcgaccccaagttcctgttgtttccacactgaggtcactgcacagttccctggctgtgaaatgaggtgggtttggtgcagacctcggaggaggctcaagtgcctgttatggagtttccagcccacagcgcagggcctggctggtgggaaagagcggtcggtgcacctcggcctgcctgcgagtgtggcacatcttttactcactcggactcagagaaacccaacgtttgccccaagcgggctgctcctccagtgggggcctctgctccccaaagccctcatttctacctgggccccaccaagaacagggaaccaggaggcctgggcatctgtgcaccacagcccagccctctccagacggagccccgagggggcccgaaggcatcgaactgccctggcctggcccctgcagagacagccttgggcctcaccaggagcactgcccccgggacgcctcaaacgtcagctctgaccccctcaaacacacaaggtgctcttagggggaaatggggcagatgcctgagggactcctgacctggtggcaccagatccagtctgaagggacgaggatggaggacggaggttcatatccacagggagagaggggccctgggaggagggggccgcgtggggaggggagcgccacgttgggaggaggcggccgcttggggaggaagcgccacgtggggaggaggcggctgcgtggggagggaagtggggaggagggggctgcatggggaggtagtgcagcatggggaggagggggccatgtgaggaggagggggccgcgtggggaggtggggaggagggggccgcgtggggaggagggggccgcgaggggagtagggggctgcgtgacgaggagcctccagcaccgcaacgcccaggaggcgccaggttaggccatctgcctggcctgttcagccgcttcccacacctgacaggtcagatgctgctcctgccacggggccggcgacgagccacaggctcccgaaaaaggcaaggggttcactttaggaggggagaggtgagcgggacggggacgctcaggtcctgggtttcaagagaggatgtggtgccggctttgattcttgatctttatcttacgactctctcaaatgtgggaggtttttcacgtgtattttctgaagagagaaaagaatcagttgtccctaaaaagagaaaatgaagaagagggactcacagatttggacttggacaggctgccgagggtctgaacggtcttggagatcaatgtcagcgtcctggacgtctgggggtcctggggaggcgggagcaagaaaggtctatgtcagcatcacagaaatgctgtgactgtcccagatcgaggggacgaaatgcaggagtcacctcagagctgctgtggcttgtgcatgagctacggagaaacaggggtagcgacgcagatgggactggagggggtgggcgtcccacagtctcaggagctgctgagaccatcccgcaggcaacatccgacggcaccgcggtgacccactctctcggcccagcgtgcagggtgcatctcaaagtcgaaagcatcaggtggggtcatggctctggggcgctgagtctcggggtgctgagtctcctggccctgcctggggctcatctcagccttcacagggtttgaaggttcaactcagaagtgctgggggccgggcttggtggctcacgcctgtaatcccagcacttcgggaggccgaggcaggtagatcacttgaggtcaggagttcgagaccagcctggccaacatggtaaaaccccatctctaataaaaatacaaaattagctgggcgtggtggcgcacgtctgtaatccaagctactagggaggctgacgcacgagaattgcttgaacccaggaggcagaggttgcagtgagctgagatggtaccactgcacgccagcctggtgacagagcaagactctgtctcaaaaaaaaagaagtgctggggaatgggcaatccctcacgtcctctcgccctggccatctccttccagctctgccacccgcacgtgcaacacggtcaccccagatccctgtaccctgagagctgcggccccagcaaccacattggggcctggagaaaatcagtgctaaataggaatctgttgactcaatacacggatgatacgccgatcatcaatactccatatgtgatgggcaggggaggagagcagggcggtgaccagcagctaaaaccctggacaaaccgtccactgcttttgtgacactgtctcgactcccccagaacgtacacagcttaaataggtcggtgaaccacctgcaacgaggacgttccaggacccagcgcatccaccagcactccccacgcaccgtccacacactccacacacactccacacgcactccccattccacacaccttccacactccccgtgcaccgtccacacactccacacacactccccattccacacgtcttccacactccccactccccatgcaccgtccacacacactccccattccaaacgcactccccactcactcattacacacactccccacgcattccacacacactcctcattccatgcacactccccatgcattccacacacactccccattccacacacactcctcattccacgcacactccccactcactcctcattccacacacactccccattccacacgccttccacactccccacacactgtccacgcactccacacactcctcattccacacacactccccattccacacacactccccactcactcattccacacacactccccattccacatgccttccacactccccacgcagtccacgcactccacacactcctcattccacaaacactccccattccacacacactccccactcactcctcattccacacacactccccattccacatgccttccacactccccacgcagtccacgcactccacacactcctcattccacaaacactccccattccacacacactccccactcactcctcattccacacacactccccactcactcctgattcctcacacactccccacgcattccacactccacacggtcggccccctacagccacgcagatgccccaacccaggccggcgtcgcaggacagctcagaaagcctcggtccctcagccggtcactcaccgtgtggtgcggcgtgagctggaagaggttgggggagagaatggcgggcgcaaagaacctcaggaagatgaagctgctcactgcagtgtacctgacgtccgggtcatctgcgggagagagaagcagggtgaccgttttcctcgggcacaatggcctcgtggggacaccatgccccggccccctgagggtccgcagggaagtccagccacagtcctggctctatctccacctgtgtctgtctctctccctctctctgtttccctctctccctctctctgtttccctctctctctccatctctctgtctctccccctttgtctctctccctgtctctctccgtatctctgtctctctctctctccctctatttgtctctctctcatctctctgtctctctccctctctttgtccctctgtctctctccctatctctgtctctctctctctctctccgtctctggctctctccccccctccatctgtctctctctctctccatctctttgtctctctccctctttgtccctctccctgtctctctccctatctctgtctctctctctctctccccctctctctctccgtccgtctgtctctggctctctctctctctctccatctctctgtctctctccctctctgtctctctccctaactccatctctctctccccgtctctttctctccgtctgtctctctctccatctctctgtctctctccctgtctctctccctatctctgtctctctctttttctctctttctctgtctctctctctccgtctctctctccctgtctctatctctctgtctctctctctctctctccgtctcgatctctctctccatctctctccgtctgtctctgtctctctccatctctctctctccgtctctatctctctctccgtctgtctctgcctctctctccgtctgtctctgcctctctctccgtctctccctgtctctctctctctctccttgtctctctctgtctctctccttctgtctctgcctctctctccatctctccctgtttctctccatctctcatcaccaccacacagcgcagcccctttggtgtctcattccacagtggtctgtgctcatctgggtgagaggatgtgttttatctcttcacttccaccttgttcaaagtgggtctggggctgggatgtgcttgggaactgcctcccccagaaccctgggcccctcggccggcgctgtctgactgtctgatgtcctgagaatcaggggtggggacagcgtttgtctcctggggacacagaagcgtggacggctctgcaggaccatggccaccccggggtgtctgcagctgtcccgaggccacaggacacgcaaggaagagaggagccggcagcaaggccctcgctgagcctctcagcgccccatacatagcctgagtcctggcggggtcttgagtatcgcaggtgatgggtgggtgcaggcacccagctcctccctgagggtcggcaaggttgagaagtggggtttgggtgctggatgcccaggtccctaggggatctccggcttgggggtttgaagaaagggcagctcccccaggggtcctgtctcttcgaagacacgggcaggcagagcccccaacaccactctgggccctgccagggtcggccacaaaaagaaaccactgggaaaacccaggggtccacatcaggaaaattcacattccaccccgacaaagcctggccacccttcccggcccccccagagaccactgtggtcgtgaactccagggctgggcccctctagagaccactgcggtggtgatctccagggctggggtcccctggagactactgtggaggtgaactccagggctggggtcccccagagaccactgcggttgtgaactagggaacactggcccgggcacaaaccccggaaaaatccagcatcggaactggggttcacgaccccgcagttctagtctagccagggctgcggggggttctgcctgggtgggagtcaccctgcacagcgctatggcagtttctcagcaacatgagggtgttcagggcactcaccctggaagcgcttggccgccgcctcccggagggagaagaagatgtcacacatgacggtcgggcagctcaccccagactcagtgatggcgtggaagacgcggtccacatactgccgtaggttctcctgcaacgggacacggcactgggacccactcccgaggctgcccacaggtgcgtgtagcaccagggcacgcccagggaggggcgcgtggggaggggctgagggcgggcgcagggcagctgcggcagtgagacacgtgtgaacagccactccctggaaatctgtgctgggagctgtggcaattcacgcgtgaaaatcactacacaggcaccacgtcggctccccggctcggccccgacctcgtttactgagtggggaatggacgttcactagaatgtgcctgcccaaggcaaagagctctgtcatttacatacagaaatgacgaaacagcacgctctgcaagaagtatcatgtgaagtgactaaaatgttggagcaagttcaacatcagggagttttgctgttttaaaacgcagtacacagctctggggacagcctggggaggcagggaggccatcctgtcctaggaaaagggaggggcaggagccattgcccaagggaaggaggagccggggcggaggcagagctggtcaggattgtccaggggaggcagagcagggtgtgcagggcagaccctccgggggggcagagctggggcatgcagaccggatcactccaggggaggaagagctggccgggaccccccaggggacgcagagcccggcacacaggccaggccaaaggtggtggctgaggcctcccagtagtgcagccagcgtactgcagccgggtgaggcgggtatccccacgcctggtcctgctcccaccccaaccggggtcacggggtgagtcagagcttccaggcagccatcggctgaaaaaccccaagcaggtgactggctttggttggttcatgaacaaaacctaccatgttgttttcaaggttttctccgtctttcaacttcacagggtcgatttcacagggtttgtggctctggcatatctggggagaggtttaagacagggctctgtgagtgggttctgggggcacaggcagggagggtggaaggggtctcaggcctggctgagatgtagaccctgagcctcatccagaaaatgccacgacagctccccgaacccggccactggcacggaggggcacggtgaggccggactgcagggccaccgtggggtggtgtcgtcccgagcctcagctgcaagggggcaaccctgggcctgtgtcactggctgcggagggacaagtgagaggtcaggcgcaaacactaggcacggggcccagtccatggccgcgatcagacgagccgggctctctcagggagcgatgtgcgcccgcgatcagacgaatcgggctttctcaggagtgatgtgcaccagcccacacggactaggcctcacagggctttaataatatttttacttcaaaatgctgccatgattttgcccacagagcaaaccagaatgctatgttcaattttctcacatttgcaaagaacctgtttacaaacccgctcataaacggggggcacagcctggcgggcatcagagggtcaggtgaggagtgggtgtgcgggcatcagagggtcgggtgaggactgggcgtgcagctcaaacatgccacgcagccagggcccaaacacaggggactgcaggacatgtggagaaagaaggtctccctgggaagagccaggcttttcttgcatgttctcctttgtggagtggtggattttcttatgtatagttttaatttgggagaatttggaaggttctggagtacacagggaacatcctcttgataaaagtgaatgaatcagcatccccgtggcgaggccagaggggccgacattcaagcccagctcgtggtctggctggatcccagtgcagtgccctctgttgggggaaatcctccccacgcctcgtgaggctgaggactctcggccccgtgctcacctcctcgatggcgggcttcagggtgacatgcaggtaatgcatccccgccagcttcatggtctcgtcgatgcacttggacgccagtgagtttcctcggaagatggtgttggggtccctgggaaatggcgatggggacagcgtttgtctcctggggacgcggaagtgcagacggagcagagcctggccccgagcacctgcctgtgggctgtgaggtcagtgcacgcccatcagtcggcttcctgacattttacaaggagcacaaccaggccaggtgcttggaggccctggccatggaaccgtcctgtgtcaacactgccagagggaaccgttcggctacctgcgtggccaccagctcaggaggagcctggctggccttcgccctcccgccctctcccctctgcggcctctgcctgtgcagagagttgggcaccagaccctggcagcatccaagggccagcagagaagcaaaccctcctgtcagctacagtggctgcaggtgcagccagatgtttctagaacagggcgtccggaaacagcactaggcaggtcctgagggaagctgtgctccatttttgtgggctcccaaagtgccccagggaggggacctgagctgtcctcgagccccaggagccgtttcccctccccactcactcactctacccgggatttcaaaggcaaatgggactttcaaaaaaaaaaaaaagaatcattaactgggtctgtgaaagaaaacctgaatcaacatggtttctggggacccttgaattccctcaagccctgccccaggacacgtggttctcggcgacgaccttgccatccctgtagcgggtccaggccgctctcccccggggcagggtgggcactcactgggtccgcttcacctccgcgctggcgatggcactgatgaatggcaccaccctgccatagtgtaggaagagccgcaccagcgggacggccgcctcctgcttctcccggcaaacctcgcccaggatgtgggccgcagacgctgacacgggctgcggggaggggtgaggtcagtgccagggcccggggtgcaggaaccccagaggcctgtccccaccttggctggggtctcacttccagccacaatagatacggctctttgctgagacagaaacacacacattcacaaaaacaccaaacttcccatttgctgctgcttggctggacccttggaggggcatctgcacctccttctagcgacccccccatgcagccagctctagggcccctgagccggtagagggactctgatgatggggtccccctcgaacaacccggagagtccttagcatcaccaggctcccacggctctaactgtcgacggaccagtgcccccagcaaaggggtccaggcatctggacgggaaacaggccaggctgggaggcgtgggaaaggccccctcagggagaaggtgccctctggggtgggcccgggtgtagggtggggccccaggcaggtggcacctcctgcccacacccacaggccacggcgtggacaagcacctccacatccgcagacttcaacagcaggtcccgcagagggctgtaatagtcagaagaaaacacgtggtcttccgtgtataccacgttcagccgcagggagcccaggtcgtctggctttaggctcttgctaccattgtcccggggctggaggaagtacctgggtgggagggacacatggaggggaggcatgaggctgcatctgccaaggagcagctctcagggaagcccagctgcctgcttgaggtcgactggtcaggagggtgatcctgtaggacccctcagagtgcagcccctggggactccccaccgaagacccccagcagggctggtcaccggggatccccaggaggcaagtgttggagccaaaggcgcaggagtcaaggggggaaacgcggagggggatgggggtggaacgtggcaggaacgggtttccgggaaccggcacagaagtggtcagtgacccgccctaagacccacacccagcagtgtcagcagcaggtggaaatgaaaattatctcaaccaaagtgtgccgtggctcccgatgtcacggggtgggggccttgggctagtgagcctggcaggccacctgggcacctggtcattgtaagagacgttttctgcccggacattcttccatctttggttctaccccacgcagtcacccaggagccctcttctgctctcatttgtgggccaggcagtctaagctctcaggtgggtggagcctgtgtccgaggccccgcccccatcaggtgggtggagcctgtatccaaggcattagcccccgtcaggtgggtggagcctgtctgcagcattagcagcccggtcaggttggtggagcccgtgtccgagacattagcacccctgtcaggtaggtggagcctgtgtccgaggcattagatcccccctcagatggatagagcctgtgcctgaggcattagcccccgccaggtgggtggagcctgtgtctgagacattggcgcccccgtcaggtgggtggagcctgtgtccgaggcattagcccccctcaggtgggtggagcctgtgtccgaggcattagcagccctgtcaggtgggtggagcctgtgtccgaggcattagcccccctcaggtgggtggagcctgtgtccgaggcattagcagccctgtcaggtgggtggagcctgtgtccgaggcattagcccccgccaggtgggtggagcctgtgtccgaggcattagcccccgccaggtgggtggagcctgtgtccgaggcattagcagccctgtcaggtgggtggagcctgtgtccgaggcattagcccccctcaggtgggtggagcctgtgtccgaggcattagcccccctcaggtgggtggagcctgtgtccgaggcattagcagccctgtcaggtgggtggagcctgtgtccgaggcattagcccccgccaggtgggtggagcctgtgtccgaggcattagcagccctgtcaggtgggtggagcctgtgtccgaggcattagcaaccccggtcaggtgggtggagcctgtgtctgaggcattagccgccccccatcgccccaggtaggtagagcctgtgtgcgaggcattagcaccctggggctctctggggtatgtggtggctgccttggctaccagggccagggattcattcagcataggaggaagcctaactcagctcagggggcctgtgcccgtgccgtcttcgtagaatcaaaagacacgcgtgtttcacggtttctgggatggaaacctgccctcacacatggcagagggacacatggggtgcgaggccccggcacacagtccacgcctgggagtgcacgcttcccgtgactccgggccctctcaggagctgcctgtcgctaagggacacacatgaactggagataaaatgaaacaatggcctgttccttccaccaaaacaccaagcacctggagacaacaggaaagaaaggcaggaggcagcaacacacaacatgtcctggggtgggttctgggtcagagccgaccactgaggtctagacgtgcagaggggagtagagaaccctgtaatgcgccctcaacaggaggtgctgccgagggcccagaacaagacccggagcgcagccgcggcgcagccctgctgtgtgcgcattctgggctcctgcaccggctgctgatgccctcccctactggtgtcagacctcacgagctgctcgcggctcagggccccgctttcacccaggatcagaccccacgagctgctcacagctcagggtcccactttcgcccaggatcagaccctgcgagctgctcgcggctcagggtcccactttcacccaggatcagaccccgtgagctgctcgtggcttagggccgctttcacccacgttccctgtcttgttttgaggtgccagccattgtgagtccctgctcagtgtgatccctgctgcctctcctcacctgccatttctcacctgctgtggggcagaaactcatcaagccagagctcgtcagagctacatgcaaagtaagagcaggtgggtgctgggcacagccgaggaccagcacatgtggcctctgtgcctttccactcagaggcagcacgtgtttttgtggctctcagagatgcggaagtctgcaggtgcaacatcatcttaccacgcctcgtaggagctggactgccgcaggactttcaacgggatccttagttctcccaggaattcatctccaaacttcaggttactggcattccagaggtcaactctgaaaaacagcatcaggacagctctagctgacggcgggcagcccgtgtggagcaaagatgacaggccacgctttgttcccccaggagcagaatggagcctgcagcgcctcccagagtctccatcaaggctcagcccacagggcacgtttcaaacacgtcagaccagcctgtggctttggaataaagatgagtgtctcccagtggtaatgggcaggcagaggaaggcggaaggccatgggcccggactcagacccaggctcttagataggagggagcctgggcatcgctgcgtgcacccagaagctacatgaccccaggctcttacataggagggagcctgggcgtcgctgcgtgcacccaggagctacatgaccccaggctctgtgccaggagggagccaggcgtcgctctgtgccaggagggagccaggagttgctgtgtgcacccaggagctatgtggctgctgccactctcagctccagcaccatctgtcccctttgcccacaacaggcccagcaccagcagtctgtgcacggcgggcaaatgtagaaccctgtctccatggattgctcatgatctaggggcacaaagtggattcaggggccatgcacaccacagcggggggagaactgtggccacaaaccacagcacggtccacgaatctccgtgactaccgcaggcccagcattgtgaagcttctgctcatgtctaacacagcagcggctcccactaatgttctgtcctagtgtgggatggtacgtgtcccctcagacctggggctgtgaaattctgacagacatacagcatccccggctgcaacaagtctacagggctggtaacccagtccctcatggccaggacccactcataggcctgaaacacctgaagtcatgcgtggccagccctacccacgggcctgaaaccacacagttacacgtggccagccctacccagggggctaaaactcggcaggcctaaccacactgtgggcatcaggggcatccccctggagggagaagattccagaaggctggggattttgttacccttgcgaatcctgcagggaagtggcaccacagaggcactggcatctgggccggggagggctgacaggctgcacaggaacccacagcgcgttcctttcagaaggaacatgaggggaccgctgatctgcccatggacactttaaaaaaatgtgctgagtggccaggcaggcgcatttgcctttaataagggaaatatttaaaacatgttttgtgtgcttttaaaaaatttaataactaggacttcactcctgaattcaaaacttggtgtaaaaagaaaccaacaatggcgcttccttctcttgaaaaaggggctggtgtgagtccctggggaggcagatctgaccgaccacgtcagggacattctatggttcaggaccctgacccctcaggaggtggatctgactgaccacgtcagggacattctatggttcaggatggagacaactatgggggacggatctgaccgataacatcagggacattcctacagttctcaaccacaaaaccacgcctcccagcagccgtagggcctgagccacgcaccggctccacgtgtcccattaagggtccccccagggcagtgttagcccctgggagggagggtgaccagggatttgatggccagcacattctccaaaatgacctaaagaaagcaggtgcatcccaggctcagggacatcccaggctcggggacatcccaggctcggggaacatcccaggctcggggaacatcccaggcttgggggcatcccaggctcagggaacatcccaggctcgggggcatcccaggctcgggggcatcctaggctcggggtctcagggccggctggggagggtcaggagggagccgtttccttccttctctgtccagcatgggaagattcgggggcttcaggggaggctcatctgcctcttcatagggaatggaggcattcgttggtacagaaggaacagaggctacgttcaaaaataaacaggaatccagcttattttcactgggaggagggaacccgccggggtttgtgaagggcacattctgacgcctgccctccccagaactctgagtcagcgggatcgtggggctctctaaatcctgggcctgagatcgcgtcctgacctgcgtgaacccacaagcgatttccccgtttcccgtgggaggcgttgaggagccaggaaagggcggtgggggctccatgggcaaaggctgaagatgcagcttctatgaccatacacaggaaacatgaacccaggacgccaggtgagagtgtttcactcgagtcaaaggggacagggtctccacagaggccacccagccgagagtttcagcagtgccagtgggtcctgctcggtcagggccaggcgtcgtgctgacccgccaggccctgcgacctctgagtgaggcctgaacccatggaaggcggagggcttagaacaagaccttaagaacggctgcagcccccgtcactccaggtggatgaagccttacggccagagggatgcggacctctggctttcgcctcttcgcaggtattgcaaggtgagccctaacaccacccacaggctgtcacttcaactacaacttctaacatcctgttgtgaaaattaccaagaaaatggaaattcatttctatctatgaccctatatttagtaacaaagaacaaaagagctgaggagtttgggtgaaaactgccaagttggggacgcggagcctggttttctcacctgatttcgagcttgtccacgtcttcctcctcaaagtcaaagtgggacttcttgctgtagctacagggccgggtcacctggagtcagacgagagagaaagcgctgagaccgcggtgccaccaggcgggggtatatgcggacctaggccccgggctgccctaccctctgcgcttacccacacaccactcaagggccacaaccaggaaggcgccaggcgggattcgggattcaggcctggcttcctgagtgccagcatttcctactcacggcgcccctggaggggcagacccaggtgagacctgccccaaggctgttcacggccacggccggactctcccagtggctcctgatgggtgccgggctctgggtacctaaatgtccgtcacctgcgcctgctctgggcctgccaccccgtgagggagggagggtcccctctgccgtggagacgaagccagcgccgccctcccgtggccccacctcaaggctctatttgccaacaggaagtgaaacgcgtgaggtctgtggagcctgaacctggccggccccgaacaggccccagcactccagggagggtcagacggtggaaagtcaagacgctgctaccttcctcctgacacctccgcaccgtgggttccttagaacagaaacggagtgaaggcgtgaagggtcgaggctccgggaccgccccccgccagccagcagggcccttgcagcagagcaggaggccgacccacaggctccaggagacagtggttatcacctggagttccgatttaaccaccatcagccgtgcaccaggtcacctgcgtttacaagaagggctccgtcctgcccggcctccctccctgcccccccttctccgggcctcagcagtgatgctggctcaggagctctcagctcgaagttctgatgtaaggcttgacaccaaaatcatgttgctaaaactgcctaacctctgagcttgcacttcctgattggtaaactgaggtgaagatcacgcaggggcagttctctgcttcgggttgagggctgctgacgcctcctccttcctgacctacacaccactgtccaaaaatttgcttccccccaacttccccatctcacaaaactcaggtcaggcaatgcctcctccaggaagcccccagtgcccctgcctcatgccctctctgcagggcaggtcaggcaatgcctcctccaggaagcccccagtgcccctgcctcacgccctctctgcagggcaggtcgggagctattgtaggggcttgtctgtttgcatccctcccatgctggcctggtgtggtggccttggactcctctgttttctgccacatcttatcaccagctgatcaccagcacggtgctggcacctgacacgtgttgagtgaatgaaggcagctcctaccaaatttatgagattatttaatctcatttagagagttaaagggtcttaatgtgtctagttgttatcctggaagaaaatggtacagacgctgcttcccatagaaacggaacatctgttttcctgggtctgctcccagtaggtggctgtctgaccacagcccgcgggggatgtgctccctccccggggctcagcctccagctgggtcagaagcagctgaagccgaaagagacagagtcctggtgaaagaggtctgctaaggaaggggaggagacggagtgaaaggtcacagagcccaaagagcagggccccgcgcgtcccacacagcagcggtcagcgaggtccgggccttccctggagccccacaggtggtgacgcagaccatggttttcagactgtctgtggtcactaaattgctcctgtaggctgagacccacgtctttacagagtgaaacaggagtgcacacagtagaaacagcatgagaacactgcaagcgtgatgagcacccgtgtgtggccgggcagtgggcgagctctaccccactgtgtgtatgacagctctgtgtgtggcagccaagccagcagccgaggcggggggagctgccacctggaactcggtccatgctgcatgcctcctgcacctccaacagggcccaccctccccctgggagcctggcagctccctgccttccctcgctctggcaaaaccatcttctccgcctgtctataagtgaggcttccgtttgagacagagaacagattccacctctaaagccctcctcacagtggccctgaaagcctggccctggctttggacaccaagttcccacctctgcctgtggggccctttcgagcctcagcagtgccagtgggtcctactcagtcaggacccactgaccggtaggtccactctcctacggtcccctgagagctgcatgcatcgagccccactcagccatcatggctcaggggagcccgcccgacccctcagatgtgactggccatgctcttgccacagaggcctcatccatcctcacatctccagggcctgtgcaccggaatgtttgtggatgggaagaacatctgcctaaaggccctgcacacagctgtccccaaaccgcaccggccacatggcaggtcctcactccacgagatgcagccatcccaaacggggtcacattccaccaggtgcacccttgcaccctccttttcatggattttggtgcttcatgttctgagaggatctctgtgtctgaatcctttcccctttgtttcaaaaccctgcctatttccactggaacaagccttccgcctctcagggatgcttgggcagagcagccaaaaaaacaaaaacccccaaggtcctggtaatttggaaagcattaatctgtcatcttttaactcaaatctgggccagttcgggagacaacgaatgacctttctctcttgggagaggagggaaggtcctgtggccacgggtccaatccccagggctggctggctgggctcgctcctctccggaaggaacccagggccggccggcggggctcgctcctctccggaaggaacccagggccggctggcggggctcgctcctctccggaaggaacttccagagggaagagactgagatcattctggatccagactttctgccaacgtgtctcgggtgcagagtttccacttaacgttgacccatgaagataccaacctcaaaataaaacacttcatcgaactggggattgttggtcttcctcttcactttcgtcttctttgcttctgatctgttatcaagtgagaaaggattgggattaaaacaacactgctgattccaagtctctcagtggtaaaaccgagctctcaaatgcacaagtcacttattggctttatttattttataaatatttctgctggtctccaactccagatggtatgcaaatcaggaacctttactcagccaaaaatacccagcgtgaagagcatgaaggcttcattttctacaaagcaattttggagcaataaagaaaacaaaaggaagtaaaaattcacattctacctcaaagcgcaacctcctgactcctcccaaatgaggcagtggtctcgtgatttcagagctggaccctagccccccaggaccagaacagaaacctgaagcgtgaggcaacttgcctgaagggtcctgccagcgtcacggtggcgtaggggtcacattgcccattcacgatggggaggccctggcactcgacgatgctgaggagagaagcagaggcggcgtcaggagggagcgcagacacctgggcgaatggcgagacagctctgggtcaggcaggaggcctgagttcaagctgtgagatgaggtttcctcaccggaaggcagggagggccacaccagccattctgcctcggtgtgacgctgaatcacgctggccattcacaaaagcccaaaacaacacctctaaggtgagcatgtgctttagcgtggacgccagcagtgtgtgacagcacatctaaagcagcgtcatcgggggggcggggggcaggacccctaaaacagtgtcatcctgggggccaggacccctaaaacagcatcatctgggagccaggacccctaaaacagtgtcatctgggagccaggatctctaaaacagcgtcatcctgggggccaggacccctaaaacagtgtcatcctgggggccagggcccctaaaacagcatcatctgggagctaagacctctaaaacagcatcatcctgggggccaggacccctaaaacagcgtcatctgggagccaggacccctaaaacagtgtcatctgggagccaggacctctaaaacagcgtcatcctgggggcccagaacctctaaaacagcgtcatcctggaagggggccagaacttctaaaacagcatcatcctggggcaacctctaaaacggcatcatcctgggggccaggacctctaaaacagcatcatcctggggccaggacctctaaaacagtgtcatcctggggccaggacctctaaaacggcatcatcctggggccaggacctctaaaacggcatcatcctggggccaggacctctaaaacagtgtcatcctggggccaggacctctaaaacggcgtcatcctggggccaggacctctaaaacggcatcatcctgggggccaggacctctaaaacggcatcatcctggggccaggacctctaaaacagtgtcatcctggggccaggacctctaaaacggcatcatcctggggccaggacctctaaaacggcatcatcctggggccaggacctctaaaacggcatcatcctggggccaggacctctaaaacggcatcatcctggaggccaggacctctaaaacggcatcatcctggggccaggacctctaaaacggcatcatcctgggggccaggacctctaaaacggcatcatcctggggccaggacctctaaaacgacgtcatcctgggggccaggacctctaaaacagcttcatcctggtgggccaggacctctaaaacggcgtcatcctgggggccaggacctctaaaacggcatcatcctggggccaggacctctaaaacggcatcatcctggggccaggacctctaaaacggcatcatcctgggggccaggacctctaaaacggcatcatcctggggccaggacctctaaaacggcatcatcctggggccaggacctctaaaacgacgtcatcctgggggccaggacctctaaaacggcatcatcctgggggccaggacctctaaaacggcgtcatcctgggggccaggacctctaaaacggcgtcatcctgggggccaggacctctaaaacggcgtcatcctgggggccaggacctctaaaacagcatcatcctggtgggccaggacctctaaaacggcgtcatcctgggggccaggacctctaaaatggcgtcatcctggtgggccaggacccctaaaacagcatcatcctggtgggccaggacctctaaacagtgtcatcctgggcagccaccggctctggaaattcttgtgcgttggtgtgaaaacccctgtgtgctcctcgggagccagacatgccactcgctgtgcgctcggtctctagtgaggacgtgtcttaccgtgtggcgagcttgtggcagacgaccccagtgtctgtgatgacctcgctcagccgcagctccaggtgcactttgccctgcaaggcacaaggatggggtgtcagaggctgtggcgctgctcccacaggccactagggccgcgcgcccagggaaagcctagagggcaaagggagcaggcggccccgccctgccctggccaatgggcacgtccagcccctccactccacccccgggacgcagggtcccagctgtggcctttctccaggagagctgcttgcctgactgctcagccccatgtggctgcccaggctcctggctctgctgagagcaggtcgctgcctcagaagtgaggggtccaaccgtgtaggagacggtcattcagtgaagcagacccccaaaggctctgatgctgcaggctgctcgtgtgtccgtcgggacaaaccagaggggaagcacagctgtctcccaagcaggggccactgcctttacctcccctcgggcgaggccggatggaggcccgcaggaacctcggagagctcacacagagggcaaggctcacacagagggcaagactcacacaggaggcaagactcacgcagagagcaagactcacacagagggcaaggctcacacagagggcaaggctcacacagagggcaaggctcacacagagggcaagactcacacagagggcaagactcacacagagagcaagactcacacagagggcaagactcacacagacagcaaggctcacgggggcttctagcagagcagacagcaaggctgccctgcgggtccacctgtctctctagatcagtctgtctgtgtgtgctgctgtgtccatccacctgtctgtctgtgtgcacggctgtgggtgtgtgtccacctgtctgtgcgtacaactgtgtgtctgcctgtgtgcgtgcggtttgtgtgtgcagctgtgtatgtgagcatgctgctgtgtgtgcatgtccacctgtatgtgtgtccgcctgtgtctgtgcatctggctgtgtgtgtgcagctgtgtgtcctcctgtgtgtgcggctgtgtgtctacctgtgtgcgtgcaactgtgtgtgtctatgtgtgtctgcctatgcatgcatgcgactatgtgtgtccatctgtgctgctgtgtgcgtgtctgcctgtgtagctgtgtgtccgcctgtgtgtgcggctgtgtgtctgcctgtgtgcgtgcaactgtgtgtccatctgtgtgtggctgtgtccacctgtgtgcatgcgactgtgtgtctacctgtgtgtgcatgtgattgtgtgtatctgcttgtatgtgtccacctgtgtgcatgttcgcctgtgtgtgcatgcagctgtgtgtgtctgcctgtctgtgcatgtggctatgtgtctgtgtgggcgtgcgattgtgtgtgcgtgtccgtctgtgtgcacacggctgtgtgtctgcctgtgtttgcatgaaactgtgtgtgtctgcctgtcggtgtctgcctgtctgtatgtgcatctgcctgtctgtgtgtttggctgtgtgtgtccttctgtgtgtgtgtgcgactatgtgtgcatgtctgtctgtgtgcaagcagctgtgtgtgcatctgcctgtatgtgcatgcaactctgtgtgtgtctacctgtctgtagtgtgtggctgtgtgcatgtccttctgtgtgtgtgcgcgactgtgtctgcctgtctgtgcgcgtggctgtgtgtccacctgtgtatgtgtgtttgtccgcctgtctgtacatgcgactgtgtgtgcatgtctgcctgtgtgtgcaccgcctgtgtgtatgtgtgactgtgtccacctgtgtgtgtgtgcggctatgtgtgcctacctgtgtgtgccgctgtccctgtatttgctccagcctgaatggcaatgaatggatgggataaacacagactcatccatgcttcaggggctctgcctggcccggcccttagctctagctcctgaggctccgggaaggccaaggcgtgttccccagggcttgtccctgcctgtgggagggtgggacagacgggcagaatgcctggcgctaagacgtggacggcagaaccgacagcagccctgcagcacgtggcctggtgcagaacctcggatggagcagggacctcgcttaggccccacccacctaaatgattaaaaaaccttcgagttccttcaaaaatatatcagacacctagccagccttgagtggtaaatcacctaacaagcaaaataaataataaaataatagccaaaaaattagtcaggagatatttattccctatacaagttaaaaatagcatcttaacatatgtccctaaattgtttttcaaaaaccgagaccctcaccaaacagatctaccaacacagaccacaaatgcaggggggatcacaggcccgaaccctgaacccggctctattctgaatttcttcctcaggggccaggaggggtcatgcctgtgggccagagccaacattcttttctgctgatctcaattgtttggacaaagcttctcctccttaaccaatcacaaatcaaaaacgctctatatccgacccatgggccacacgtcgtgatgtctgccttctcaggtcaaactgacatacggcctccatgtactgatttatgactttgccacaacctcagcctccccaccttctgaaacccttgcctgtgaaccctcggggtgcctgggtcgtgggcgcagcctgccctgccagggtgcacaccccgaagcccctggtcagggagtggaacataaagcccttcagccctcacttgacaccgcgtcggtgcagccccacggcacccccacacttgatactatgccccacggcacccccacacttggcaccacgttccacggcacccccacactgacaacacgtcccacggcacccctacacttgacaccacgttccatggcacccccacactgacaccacgccccacggcacccccacactgacaccacgccccacggcacccccacactgacaccacgccccacggcacccccacacttgataccacgttccacggcacccccacactgacaccacaccccacagcacccccacacttgataccatgccccacagcacccccacacttgacaccacgttccacggcacccccacactgacaccacaccccaaagcacccccacacttgataccatgttccacggcacccccacacttgataccacgttccacggcacccccacactgacaccacaccccacagcacccccacacttgataccatgccccacagcacccccacacttgacaccacgttccacggaacccccgcactgacaccacaccccacggcacccccacactgacaccacgccccacggcacccccacactgacaccacgccccacagcacccccacacttgacaccacgttccacggcacccccacacttgacaccacgttccatggcacccccacactgacaacacgccccacggcacccccacacttgataccacgttccacggcacccccacactgacaccacaccccacagcacccctacacttgacaccacgttccatggcacccccacacttcataccatgttccacggcacccccacactgacaccacgccccacggcacccccacactgacaccacgccccacggcacccccacactgacaccacgccccacggcacccccacactgacaccacgccccacggcacccccgcactgacaccacgttccacggcaccccacacttcataccacgttccacggcacccccacacttgacaccacgccccacggaacccccacacttgacaccacgttccacggcacccccacactgacaccacgccccacggcacccccacacttgacccagcgctcacagggggaatggaactgggtctgtgctgcccaggcaggtgtgggaggtggggcctccgctgctgtcctgagactctggggtctggaggttgggtgtggccttcccgccctgtggctgcagccccagagcaggtcctgaggggccacaaggatgttgggccgggaaggtgggcatgaaccccacgccagcactgtgggcggggaaaacaggtgcctaaaatgacaacaaagaccccaccaagaccacagctcctcttcccacacccatcagagctcagggctgagcggagtatcgcctgtggtcctcaccgcctggcagcgggcctgctatccgtggctatccatgggctaaaggagtgccctgaacaccagccgggcagtgggcctgctatccgtggctatccacgggctaaaggagtgccctgaacaccagccgggcactgggcctgctatccgtggctatccacgggctaaaggagtggcctgaccaccaaagacaggagaaagtgcctgacccaagaataaccaagaatccccactgcttcatccccgttctcaaatgccgggcgcaaactctctcaggacagaagcgttcagatttgcaaggctgtgcagacggaggtagctctattcacattcgggagcttcaggaagagtcacgactgcatgtggggggtcctggtccccagcagcaggctgtgtggcccccgtgtgctctcccggcccctggcagcaggctgtgcggcccccgtgtgctctcccggctcctggccgggtccaggggcacctggctggtcaccatcaggtcctgaggctgctcctgttcctgcagcatgaatccctcctgaccagctgacttgtgtgctttcgtcttctgctgattcaggagtgggaacaaacaaaacccacccctggaaggccctttctcctgccagaaaagccaatgagtaaatctgcaggtgctggcgcaggctggagaatcccagacatttagaggttaaacaacacagttctaaataacacacagatcagagaacgcaagacaaattttaaaatgttccggaataaacagaaatgaaagtgttactcatcaaaatcagtgggatgaagcgggagccgtgctcggggtggaggggaatctggagtgccggccacacagactagagcagaagggagatctgaacgctgacctgagcttagagcagaagggagatctgaacgctgacctgagcttagagcagaagggagatctgaacgctgacctgagcttagagcagaagggagagctgaacgctgacctgagcttagagcagaagggagatctgaacgctgacctgagcttagagcagaagggagatctgaacgctgacctgagcttagagctgggagactgagaaaaatgagtaaactaaacccagagcccaagaacagaaaacagaagtcagatcggaaaccaataggtaaaaatcaaagccaacggcaaattccttgagagatcaataaaattaataaacctcaaaccaggctactaagagcaaaagggaaaaggcacaaattcccacaggaaaggaacgagaggacctggctgccgaccctggcacctgcctggacgctgcactgaggtccctggcgctgcactcctgcgaactcacagacgcagcaaaggggccccagcgtccagctcctgacaacgtgtggctgcagtgtcacccatggggccctgggcgggggctgctgaggggtgtatggaaactctgtactctgctcaatttccctgtgaacacagaactgcccccaaaacagagttaattaatttttaaaaagcagccaatggtccctatccatctttctcaggaaggccttccccagggagagagcagcgcgcagagccgggtcagggtcctggccccacccaccggttgccgtgtcccccactgagcgggcagcggcccagagagcagccaggacagaggtgccttggatgcaggactgttccacgccggccgcagagaggagacgaagtccgcgggcagatgagacaggatgcagaggccatgaggaaggaagcccagcctcggccgtctcctcttacaaccctggagagatgtgaaagcttgacgacggacggtgactttgtttgctccgaaaatccttccaagaggactgtctgctgcacaaacacaaaattcccagaggctgtagcaggaggctggaatttccagcccagtgagatttcacggtgcaactggaaggctccaagggggaaacacgtaggtgtctcttgggcggatggcagacccaggggtttgctgtgatcccctgcagggctgtgctattttctgaatacgtcacagatgcacttgaaagcctggtttataaacggagctcagtgacccccaggcgcccagatcaccgcggatgcctcgctgtcacaggcggtgccctcgctggcatctgacgctggcatctcccccactggcatctgacgctggcgtctcccccgctggccctgcatcaggggagggtcagagagcacaactctgcataataaagtgatttaacaaagactttccaacagtggccgttccagaaggaagcaagaaaggtttaattgtgtttcccccatttctgtgactcacttgctggcctcccccatgggctgcttctgtgacactcgctgtccggacacaggactgttcctgggaatcacagagcggagggactcatggagccacatggctaccccctgccttcctgaaaatggtcactgtgacatcttatgatgaaacggcggctcctgagactggagttgtggggttttttttcttcttcttcttctttttttgagatggagtttcactcttgttgcccaggctggagtgcaatggcgcgatctcagctcacagcaacctccgcctcccgggttcaagcgattctcctgcctcaacctccggagtagctgggattacaggcatgcgccaccacgcccggctaattttgtattttcagtagagacggggtttcaccatgttggtcaggctggtctcaaacacctgacctcaggtgatccacccgcctcggcctcccaaagtgctggaattacaagcatgagccaccgcgcccagcctggagttgaggttttaaaggttggctggagtccagcagggccactgctccctgtcacgctacgttttgggcggcgttggggctgactgcatcagtgaagcaacgcattggagagcagcgggcattggagagcaatgaccttgcctcctcccttttagacaacagctcgcatttgccttccataaagtgcaaattcccgggagactgacaccactcggttcaggatcctcatgttccggacagtgagagtcaggcttggaggacgctgggcttggccacgggtacgcagcctcgggcgttaattatgagattccaccagctgtgagatcaacctgcggcattcttatttacagctttgtggagatgcaacgtctgagtcctgatcgtcatggtggttacactatctaccctgtgatgaagttgcaccgactgtcacaacagcccatcggcaggtgactggagcaacagcacacgcttcgcacctcggaccattcctcagccttggaaggaaggaggttctgataccacaagcgacccggaggatgtcacgcagagcgacattagcctcagaaagaccagcagggtagagctcactcccatgagccacggggagtggcctgcgtcagagacagagtgccatggggctgccggtggggaaggggcggacgggagcgtgtgaataaaactctagccaggggacagaggggacggaggttccgttttgcaagatgaaaggagctctagagatgggtggtggtgacggttatacaatattatgaatatattcaatgctataccactgaattggacattttaaatggttaaaatggtaaatttcatgtctctgttttaccacataaaaaactggaaaaaatagcatagaatacacagagagacacacacagaaacacgtgcctgtgaactggtgaaatctggataacatccgtggactgcacaaacgtcggcgtcctggttgacgttgcaccagctgcgcatggcagtgcctggggaagccgggagaagggagcacagccttctgtttggggaagccaggagaagggagcacggccgtccgttcgggggagccgggagaagggagcacggccttccgttcgggggagccgggagaagggagcacggccttccgttttcagggaaaggtgggaattcgcccctcgccactcctgtgtactgttttgatgccttcctatagatctataaccatttcaaaattaaatcagtaaaaaaaaaaaaaaggcaagaaagaggaaaagctacacctgccaataaaaccaaacttgaatccgaggcaaacgacgaggccgcactctgccagctgctcagaggccgttgtgacggagaccccagcgacggcgggtatcccagaatagaagagctggggaactcgccgacacgcaggcgggagcggcccagtcaccaagccccgtctcccgggcagcacgtgggaaaccccgcctttctgccgggacgccaaggtccgtgggagcagcacgctggggcccttgtgctccggggatgcgaggacagtcattagttctgcagtaatcacagcgtccttcactttccacagcacgtgtgggttccccagccagtgctttcccaggaagcagagttaattaagtgtgacgcacaattagcacaggtcccttggggcagggccatccccagggcttcttggctccactccttaatttccgtcaagggcctcaccccacccccacagctgggctcatggtcaacttcatgaatgaaccctttgctggccatgggcgtgtgcacagctcatgaccttggcaaatggcaaccttgacccagtgaagcgcagaggatgagggttgccagggcaagacggttcccagaggacgagggttcccagaggacgagggttcccgagggatgagggttccaggaggatgagggttgccgggggacaagggttcccagaggacaccaggccatccagtcccccagcccaaatttgccctgaacttgcgggcacagagcctccatccgacccacccagttgcctctgctgaagtctcaggcgaagtcctcacaaggaacctattttggggatttgtccaggatgccagcctccaggtgtaaaaataaccatcacagccaccaatttacgatgcgccaggtgccttcgagtggcacacacgccataccagcacgcttcacaaacccacccagatgggaaaactgaggcctgcaaaggacgttggcaacaatccgatgagggagctggctccgagcctggcggcctgtgctgggactctgcactcagacacacactgtggtaccagctgaggacccaggaagccctcccacatcccagggccgctgtgctgcaaccccatactcagacactcaccctcctacgtcccagggccgctgtgcagcaacactacactcagacactcactgcggtcccagctgaggacccaggaagccctcctgtgtcccagggacgctgtgcagcaaccctacactcagacactcactgcggtcccaactgaggacccaggaagccctcccgcgtcccaagggcgctgtgccacaaccctacactcagacgctcactgcggtcccagctgaggacccaggaagccgtccggtgtcccagggaccctgtgccgcaaccctacactcagacacttactgtggtcccagctgaggacccacttgggaaaccctcccacgtcccagggttgggccacggtgcctcttgcttgtggcctttgcagctgctctgtgtcacagaccagggctcagggtgaccccacaggagctggtgcaggcttgggctccggtggactgacccccactgctccctctgttacaggcaagcctggagcagctgttgccgggcagctgggcaccgtgcgtccgtgagcagctgtgaacacaagggtctgggacatgggccccagcactggagcccccggtcttgcgtggggaggtgggacaagctccccccactggacaggaccggggtgagccccagtcagcacacagtcccggcaagccagggtgagcccctggccactttcgacaatggacacgggagaccagaacgctctttcagctcagacccttcttggtgccgcgtgccaggcaacagcccgcccagccaaccgtggggaagtgagggtccctgagggctgaccctggctcggcccttccccacccatgttttctcttgggcctcaatgacgcgtgcctgtcctttcccaccgtgtttgttttcacagcttcctcagttgtgcatgacaaagggcggcagtaggcaaagggaaaacccaaaatccatgcacggagcccaggctcactccgagcacaagtgggcgaacagacacaatgcaaaatccatgacagagcctgcgctcactccgaccacaagcgggtgaacacgcccaacccaaaatccatggcagagaccgcgctcactccgagcacaagcgggcgaacacgcacaacccaaaatccatggcagagaccgcgctcactccgagcacaagcgggcgaacacgcacaacccaaaatccatggcagagaccgcgctcactccgagcacaagcgggcgaacacgcacaacccaaaatccatggcagagaccgcgctcactccgagcacaagcgggcgaacacgcacaacccaaaatccatggcggagcccgcgctcactccgagcacaagcgggcgaacacgcacaacccaaaatccatggcggagcccgcgctcactccgagcacaagcgggcgaacacgcacaacccaaaatccatggcagagcctgcgctcactccgagcacaagcaggcaaacacgcacaacccaaaatccacacgcggagcccgcgctcactccgagcacaagcgggcgaacatgcacaacccaaaatccatggcagagcctgcgctcactccgagcacaagcaggcgaacacgcacaacccaaaatccatggcggagcccgcgctcactccgagcacaagtgggcgaacacgcaatctgctcatcgttattcccagtcaaggccgaagcccgatctacgtctttagccacagtcggagccgggcccgtctcgaagccccatggtgtcccagggctctggtttccggggctgcgccgagagtctcacctgcacttccgagtcagcgtccacgtgctgcagctggaaccaggtgtccctgttgtggtacttctgcaagtcctccttctggatggccaccttccctgcaacacaagcagagaagacttcaccacgggcacaggccccagagccaggacgcctgtgagcagaagccagcccatcatcaccgcagcttatttccaacagtttaattcagaatggggcaccggccgggtgcggggctcatgcctggaacccccacgcttgggaggcccaggggggagggtcgcttgagaccagcctgagcgatatggtgaaaacttgtctctacaaaaaataaaggaatgagccgggcatggtggcactgtatctctaaaaattgatattaaaaagtcaaaataatcaggtgcagcggtaagtctccactgtgtcccttccagtaaggcgttccagaggcttcgctgtgaaggcgcgaacgtccgctccatcggcaatgtgcgcctcactttcactgtggtccgtggccagttctcacagcaggaggtgcctcggagctggctgcaccagagctctgatctcacaaatgaacaccccgtgcctcacacaccaccaaggcagcagcatcacgccacaagagacacgtgtgcacccgtgcgagcgacagcctgaaacacacgtgtgcctagggtgctttccgtgtgtgtggacacgcacgtgtgtgcatgcatgtgggtgctcaggttattcacaggcaggactgagagccagaatgagctgccaccttcccacgcgacgtgggttggtctgaatctgtgcctctaaagtgtaatgaatgagccgccttctgggacccctggagagcctgaaagtgtagattcctggccttctccagacggaggagaacagaggctctggtgtgggctggaatctgcaccaccacaggtccctgggcacttgtgtgggccccaaagtctgggaacgtccactctaaacagtttcccgtgccttaaacaggcttagtactttggggctacgcttccagtgaaaatacgtatcagaatatatttgtacaatatacgtttacctagtatggatttatatgtgtaaattcgcatctgcaaccattattatctgcttatacgttcacctcattccagaaacattcccgaggcgcggcaaacgtgtgcccatcccatccccggcaggacagggcttgtcaggcgctgggcaccgagccatctcccatcctgcgtcccttcatggcaccaccatgtcaaccctgccagtggcctccgcacactgcggaccacgccacccaccacggtgagcacccacggcagcacatgcacctctgttgaccgatgcacgtgaactcctagggagtcgcacacacatgtgaagtctgagcccatcacagagcacacacgagagcaggagtgaggaaggaaatgttggcagactcctcacgtcttcgttctgcacccagagacacacacgccctccttaaggatcttggtccagtcactgaagtgagaaactctgggtccccgcagacccggttcaccgcagcgtccgcagccacagggtctgagcacattgtgcatgacctgggctcccgggagcggcctgggcctcctacccggccaccctgcctcacgccaggacagcgcagcccagccccggttctctcttccaaggaagatccttttatatttccgtgtctcaaaaaacttccgcaggctcccatcggaacaaccctggcctggcatccagcagccacatgcttgggcctgattctctgtccagcctcagtaaattcgggaacactccactgccagcctctcacaggtgccatctcagtcggtcctgcggtgaccctggaggagcaggtaccactctgcacaccccacagacgagcaggccggggctgcagggagagggagcttccgtccctgccttcctgccagcgttccttcctatgttggcgtccccaccctgcgaggtcccaggacgcatcttccctcaggagctcctctgcctcgcgggctcatgcgagcgagacctctcagcctgactggtccattccgtgactaatctcagagcccgtgggcctgggccaccaggcccctcctttgtctgcaaactcagagggtctgagacacgcccagctcagcaccagctccagaccctatgggacagcgcaaggtcggccacatgatggagcaccacatggccacaggacatggtgggaggtgcggaaggtggaaagaggcacaaagacgctttccaagtgcccaaaggagagagacggaatcaggacagtttgcctccagtgctgctgacacctgccatgcacgtcagcatcttcatctgatgtcctcaggggagccggctgcacctcacaccatccactctgcaaagcaaagcagccctgggaacagccctggaaaaagccccttcccagctccgggacccccgctcacagccagggccggccagttccacagctacccggacgtagatacagcacacaggcactcatgggttcctaagatcagcctggtgacctcatcggctcagctcttgccacacagacatacacaggccatctggagctgcacgggacgctgaaaccaccactgagggcaggcgagagccaaatcaagaaccaagggggccggcacaggaaacaggccccagcacatgtgggagaaggaacaccagggaggctcagagagaaatccagtgacacaccacgtggactccctccaatggcctctaatggcgcagaccacgagggtggacgacagccaggacacctccgcctggcccacctcactcgctgagccccccgccccgcctcactcgctgagcccccccgccccgcctcactcgctgagcccccccgccccgcctcactctctgagcccccccgccccgcctcactcgctgagctcccccccgcctcactcgctgagcccccccgccccgcctcactcgctgagccccccccgcctcactcgctgagccccccgccccgcctcactcgctgagctcccccccccgcctcactcgctgagctccccccccgcctcactcgctgagcccccccgccccgcctcactcgctgagccccccgccccgcctcactcgctgagcccccccgccccgcctcactcgctgagccccccccgcctcactcgctgagccccccgccccgcctcactcgctgagctcccccccccgcctcactcgctgagctcccccccccgcctcactcgctgagcccccccgccccgcctcactcgctgagccccccgccccgcctcactcgctgagctccccccccgcctcactcgctgagccccccccgccccgcctcactcgctgagccccccccgccccccccgccccgcctcactcgctgagcccccccgccccccccccgccccgcctcactcgctgagctccccccccgcctcactcgctgagccccccgccccgcctcactcgctgagctcccccgccgcctcactcgctgagccccccgccctcccaccggcagccctgggcgggcgcctttgacttcaagggtccggagtgggggctctgtcctctcctctgacgaccgctgcgtggctcttgcataacctcccctttcccccacaacacgaacctcagttttgagtctcacaggaataaagccacatgaaagcaaaaacttcttaaaactgagttgggcaatatatttcagtgaaaagggataaatcttcagactccaagacgccttcagctggacaggagggtcagttttgaagtctgaagttttaaatacttgcaatgtcactgtgtcttcacatttttatgagctgaaactgggacgggagaagtcacatatttacgtggataaaaatcttgtaactggcacatgattacaagtctttaattttagaagtacttcacttaattttttaataggtaacacagaaacagaacaaaatccacaacattcaaaaggatttaaaatcccttcgagaagggatccctgcccctgccacctcattcccgacgtggggtcacttctgtcaccagcccccaacctttccttctagaagccagccacattcaacaatggggaccgtggacatttgaagcatgcgtgttcgtatctccagatgctgacctgagagaatgcctgatctaaaagccacggcgtctacttaaatttctctgatgtgcctaatccacagggttgtccccatctatttgagtcacaccgaaaagtttaccgaacactctgggcctccctttctcacttgggcaaaggcggctgccttctcaccacgagaggccggaagggtcactttcttctgctgcatctgtgctggccaggcccgttcagaaaggaggagccaggggtctggagggcatcagacgggggaccagctgcagagggaccagaaaaaggggaaacagccacaggacacaactgagcaagagctgcccgagacagggaatgcggctgaaatgcgcgcgcctccctctgaccccacctgtgtcccagccagggccacgaggaaaaaacaaaggccatacagatcccaaaggaagaaataaaagcctttattcatagaatgtacaaaaaaaaatctacaggcaaagctaatagaactaattggtgtgttcagcaagaacagagaacacaaagtcagtgtggagacgtcgactgcgtttgtacatacaagcaatgaccatgaaaattacacaaaaacagcacctttcacaaaattatgcttttaggtttgtgcttttggtggactacctcagaaatctttaaccactccactaaacacataaaacacagggaaataaatgtttttaaatgtgcaaaatgtgtaggctgaaaacacatcacaaaacactgatgagagaaattggaaagacccaagcgtgtaaagatataccatgtccatggatttgaagactcagttttgttaagatattaattctccccaaattaatctatagatcaatgtaatcccagtcaaaattcctgtgggactattttggaaattgagaagctcattcaaaagtatatatggcaattcaaagcatctagaatagaaaaacaagtttaagaacaaatttgatgatcttacactacaatgtaagacctgctatgaagctatagtgatcaagactgcgtggtattggcatgaggacaggtggatcaatatgacacacagcaggcgagccccaaattggggcttagcctcagagggtctgtagcttcactcaggaaagaattcgagaatgaggtggtggtggaagaaaacagttttatggaggcggcagtggcagctctgaaactgctcctgcacagcaggactccccacgggcggggtgttgacagtctcagccgttcctgcagagaagggttccccataggcagggtgttgagagtggcacctccgggcactgctgcagtcttatttatcctcacttttaactatatgtcaattaaaagattatgcagacatttctagaaaaagggtggtaatttccgagtcacggggttgttcctatggaaaggggtggtaacctccaggcgttgccatggcaatggtaaggtgacatggtacactggcaggcgtgtccgatggaaagctgcttccacccatccctgtctcagctagtcctcaatttggttcggtgtccgagccctgccttcagagtccagtcccgcctcctacctcagatggaagagaatacagaggccacaaacagacccacacaatgcagccaactaagctgtaaatgtgccaaagtcatcaacggaggaagggtcgtctttcagccaagggtgccggaacaaagggatgtctacatggaaaaaacagaatcccgacccttttctttgtgctataagtgaaaattagcttgaaacagatcatggaactaaatgtgaacgctgaaagcacatgctttccaggagaaaaccgccacaaccgtggaataggcaagactttcttagacatgacaccacaggtacaaatcatacaagaaaaaaatgtgataaactggaccatcgaaattaaaaacttctgttcttcaaagccaatggtaagaaaatgaaatacaagccacaaactggaagaaaatatttgcaaagcacacttgtgatagactcgtatccagaatatacagggaactttaaaaagtaacaagaaaacaacccaattaaaagggcaaaagatttgaacaatgtactaaagaaggaatggagctgtcactaagcccaagaaaaggtcctcgacgccactcttcacggacacgcaataaaagccacagtgagacagtacacacctatgggagtgcaaacggtaactagagaataaaaactcacagtcctaagggccgggcaggatgcgaaatacctgctgctctcacccgctgctggagagaaggcagactgggtgaccacttggagacacggttgggtagttttaatgaaagtaaacacacaccctacagtgacccagcaacctcgctcccacgcatttatctcagagtaagaaacagaaacattgtccacacaaagacctatccgagaatgtttacggtgactttattcataattcctgaggattagacacaatccagagggtggatgaggcggctgagctgtgtctgtatgatggaaacccacgggcagtggaagggggcggcctggctcacagccgcacagcgcgggaccagcgcagtggcagagggcacggcccctccagggtttgagtcacgtggcctcctggaaaaggcaactgtgggaacaggcctcagagcagtggctgcccggggctgtgggccagggtaggaaatccaccccaaaggggcccaaaggagtgttccgggctgtgggaacatatcttagctgtgctgctgtctacacaactgcatacactggtgaaggctacacctaacagtgaactttaccatatgtcagttgcagaccacctgatttatacacaaagaacggaggtctcggccgggcgcggtggctcacgcctgtaatcccagcactttgggaggccgaggtgggcggatcacgaggtcaggagatagagaccaccttggctaacacggtgaaaccccgtctctactgaaaatacaaaaaattagccgggcgtggtggcgggcgcctgtagtcccagctactcgggaagctgaggcaggagaatggcgtgaacccgggaggtggaggttgcagtgagccgagatcgcgccactgccctccagcctgggcgacagaaagagactccgtctcaaaaaaaaaaaaaaagaagaagaaaagaatggaggtctcactgcacccccaccccattgggaagcctcagagagtctctaggggctggaggggcaaatggagggggacatggtgctaccagagccggggcccagaggaaggtggaggcctagcgggaaaaggagggaggcgccaggatcgggggcggagaccccaatgctcctgacagcaccgagccgggcctcgcgcatttccgtggttcccgcatcccagctgcggggagccatagtttccggtctgtgctctgtgagggcagcgcccggcagccgagtccaggcagaggccgcctccctgcgcctggaatcccgaaggagcctgcgccccgtgtgtcccgcaggtcacggccctgcagctgggagcccggcttgactgacagttcccgccggcagcagcgctctgtgggccatggacccagggacagaggaggctacggtcacgccgcccgggacccgccgacactggacacttctcctgctcctgctgtggcgggagctgactgcagccggtggaggtgccggggtgggctggggagggctgagggcaggcctttatttccccaagtctcacttgccggggcgccgtatcccggcacggcttcagctgcctttctcggtttctgtcgccaccgccctccccctccaggctgaagatgccctcccgtccccaacccacacccccgaccccataggaatgcacccccacttccttctggcacctgccagtgcacctctcactcctggacctgaacttgcaactgagcacagctgtggctgccccaagggaaacttgctggcaggtggggtttcctcagggcgtgggcggctgctagaaacgagaaccaggagaaccacgcagccaggaagccagtggccaccgcgcacttccacccagaaacgcattccccagaacctggtgtttcatgcccggtaacaacataattaccatcataaagataaatcgttaccggagatccagacagccacccattttcatagctgcgaaagccacagtgaaacatctaagtccagtcaccataatcgtaaagccaccaagaactactagcagacgacgtcaacagaatgattaataaacatcttatttggttattttcagagcatataactccagaactaacttgatcagcttctcttactaaaatgtgcaaaaattttttaaatttctttttccttagggttgtcgctcaaaaaatgtctcatacaccttcgagaacgaatcaagtccctgtggattctcgagtataaacggagctggtgacgaggcctgacacacggtcacacctcaattcgcgcgtggcgcccggcacaggctgagccccgccagatacaccattagcctccgctgaataatctggattccatgcctccctttcttctgagaacacccttggaggcccctggcaggggctgagaacacaggagcgagacacaggcctgccctgcaggaccatgggctccaggaagctctgtccagtggacacagcacaacaggcaagagaaccacaaccaacgagtggggcaggggaggcaggtcacggagggcagcccacccatgccgcggggtcggaggccatctcctgcagcaggccccagtcccagaggtgggcatggcaggacatggggatggagaaggaggtgcctcaggagtggggtgcacagcggctgagcccggaggcaggagggagaactgccagccactagccctggagccgatgccctggtcagagggagagaggaagagggaacccttccgcagcacccagcttgaacgcgacataaagctatgggcctgaacctgagggcctcccaggcagacactgagcaagggggtgcaggggtcacgctggaccctcaagaccatctcaccgacaaggctccatgaagcccagcacagcaagaccctgaaggggggtcaggtgcccgctgcactcagacaccttctgcagccgcatttcagggccagggtgtccgctgcggaagcacccagcacagtgttcccgctcaaaatgaagtcaaatgtcaattatctgagatccatgtgacccattccatgtattttctaaacaaactctggagacttctatgaaaaacacagcagtttctaagaataatcacttgggtacagtgaacaacagtcccaaaaatgtccgggtcccgacccctgcaatggtgagggggcactggccttatcaatgccaggtgaggccctgcccggccccgagggcctctcacccagccaagcccctctcaatgccaggcagagagcaagactggtcaggataggcatctcatctctgtcaggggacttgctgtggaggcccgggacatggcagagtgcagacagcctacgcgttacctactagcccgtttctctcatgccccctctctctctcaacgtcgtgctgacacacactagctgccggccgcccagtggggacaggctgggttttaggacactcaagctctgaggtggacctttggccgtgcctctcacttctgtgtgccaagcactgggaatggatcagatcacagatcctggtccatggctcacaaacagaggaacagggacgatgaagaaagcccacagctgagggacacaggtgagcgctggggaaagggggcagccggcgtggggtggagcggccgtgacacggtgtgaggagccagtgtgagcagcgagcgtcagatggaccgggaccccgcccacgcacagcaccctcgtggcctcgctggcctcctgcacccccgggccctcaggctgcctggggccaagctgggggtcccctgggggactcctcctctcgccctgtcccactcagcatcccggcagccatgaagacgaggagcctgcaccacctggggtctgggttcaggctgtggcagccagtacacactggctccccggccgcccgtcctgggcgtgagctcaggcgccacaggacccctcctcccttcctggctctcccagcgtcacggcgggaattagcctgatccctcagcctcccacgcctgctgcgtgaggtctgctcctgacggggtcctctggctgcatttaggaacaaggagctccccgagtaacctgaagtccactctgcccagaggccccacaacttacaggatgccgccttcctgtgataccaggcagggctgcccatgagctttctccaagagcagccccacccctgctccaaacacaccatctcctggaagtaacagtattgccccaaaaaccagggggaaactgaggcaacatgcccccacccccacccgcccttcctgtgcccacactgtggggactaaagttgggacagggacagccaagacgtggtgaggagggaggccccacatccatgcaaaggtccccccacagatgccccggggaacagccctgggaagttgtctgaagagggccagagatgctgtgctcttgccttgaggggccatggaagcctcgactggcagtgctcactgacctgagcctggtgtgatgctctagcagggaccacagatgccaggccagatcccaagagcagatcaggaggaacacccagggctgctgtgacctcaagccctgcagcgacccctcagcaccatccagccaggctctggactgaaatgctaatactcgcctggtacagaacaggcagaaaaggggaagtaaatgctcattcatcacctacctatgatggaatccctccggaaaacgtctctatcgaaaatgtagaaggacaggtgacgaaagctccgaggaatttcacagtaaaagtcttctccgtaaaacgggctagtgagacaaagaaaagcgccagttagaacacaggccacgcttgcgcctcacccccggggcacacacgtgtggtcttagttttaaacatgccataagaatgccctgcactgtgtggcacgcatgagacatgaacctgcagctccctgtggggtgaagggcctcgtagctgctccccggcctccacctcgagcctttgcactgcacagatgaacttctgtactgggctgcctggcggcccggaagctgagacctccacagagaccacggccactgccagaatgacttccatgctacgtgctcaggtctaggtgcagcctcagggccatcgtgatgtttcgaaggtacctggtttggggcaggcagtggctccctttatgcattaaacataaaacacagcactccagtgccttggaccgctccttttatccagagatccagtacaaagtcctgactgcccagccgccctcactcctcggggagagacccccgctgctgactgtacttagagtcctcgctcctgggggagaggcccccgctgctgactgtgcttagagtcctcgctcctgggggagagatccccgctgctgactgtgcttagagtcctggctcctgggggagagacccccgctgctgactgtacttagagtcctcgctcctgggggagaaatccccactgctgactgtgcgtagagtcctcgctcctgggggagagacccccgctgctgactgtgcttagagtcctggctcctgggggagagacccccgctgctgactgtacttagagtcctcgctcctgggggagaaatcgccactgctgactgtgcgtagagtcctcgctcctgggggagagacccccgctgctgactgtgcttagagtcctggctcctggggaagagacccccactgctgactgtgcttagagtcctcgctcctgggggagaggcccccgccgctgactgtacttaaagtccttgctcccggaggagaggcccctgctgctgactgcccagccgccctagctcctgggggagaggaccccgctgctgactgtgcttacagagtgcatggctcaggccgcccatgcgtgagtcaccaggagatgcagccgccccacagaggagacttgaaataaccacaaccccaataaagaagcagaagccagtgggctttgccattcagcaaaccttcctgttgtcctgggctggcacaggtggggttagtttcctccccacgccggacctgttggcgattactgcggtgcacgcacagctaccaccaactcagaacttaaaacaagcccactttcatgcacattgatgctaaggtccaaaataggaaagatgtaagttattcaaggaggaaccattctgatagaaagcaaaggaaggtcaacgtgctgggccagggggcgtccacacagtcaccaacggcacaggccccaccccagccacacacagaaatgagctcagaccccgcacccatctgtaagggtgtaagggttggagctactagcctctcagaagaaaatgagaatgaacctgcaccctaaagtcaggtaaagatgtcttagatctgtcaccaaaagcacaagtgccaaaagaaaaataaatggaaaatcaaacttcatcaaaattaaaaacattaaaaacttttttgcattaaaagcattatttaaaaagtgaaaagggccagtgctgtggctcacgcctgtaatcccaacactttgggaggctgagactaacgaatcacctaagatcaggagttcgagaccagcctggccaacatggcaaatccccatctctactaaaaatacaaaaattagcagggcatggtggtgggcgcctgtagtcccagctactcgggaggctgaggcaggagaatcgcttgaacctgggaggcagaggttgcagtgagccaagattgcaccactgcactccagcctgggtgacaagagcaaaactcagtctcaaaaaaataataaaaattaaaaaaataaaaagtgaaaagacagactagaaaaaatattagtaagtcagttatctgataaaagacttatatacagaatatataaagaactcttatgactcaataaatgatgacaaataattcagtttaaaaaggggcaaaagatttgaacacacatatcaccaaagacaaatggccaacaatgtattaaaaatgctccatgtcattagcccttgagaaaatgcaaattaaaccaggagatacggcacaggcataagcccaaacctggggcgggcgactgttgctgcccggagcccaggtgggaggggcccagagtccaggtgggaggggcccagagtccaggtgggaggggtccagagtccaggccccaccccttctccctgcagcggccttaatgacaggcatttcatttggatttcactgatttcagtatttttataactgggtcagagactgggtaacatttactcagaaaaccattttttgtcataaaacaatcttccaagggaagcctaaaatgcctaggttgttttaagcattttggaaacacagcagtatccatttacacacaaaagaaacatcactttatctttcaatgaaggcagaatgctcagggacttccaccgactccattgtagcagcatcctggttaatgaaggcccattagaaagtcacgtttcctttaaacacattctcgcgttggtcgttgacgcagcgagccatcctctgatctcctgcgtctgcgtgggcaccgccgagatctgatgtcagggacccccaggggtgtgtgtgcccacaggcatgtgtgtgtgggtgtgtgcacgtgtgtgcccatgggtgtgtgcacgtgtgtgcccatgggtgcgtgtgcccacaggcatgtgtgtgggtgtgtgcatgcatgtgcctgtacgtgtgtgcccacaggcacgtgtttgtgtgtgcatgtgtgtgcccgtatgtgtgtccccacaggcaggtgtgcatgttcatgtgcatgtgtgtgcccacaggcacgtgtgcatgggtgtgtgcatgcatgtgccatgcatgtgcccatacatgtgtgctcacaggcatgtgtgcatgttcatgcgtgcatgcatgtgccctggagcacttgggtgcacatgtacacaaaggcaccacagatgcgccccacacaatgcgctgctttcataacaaggcgcaggggtcgtgaccctgcctccaccctgtgtaaagtcacagctgcaggatctcggggcaggacgcacactccccaggcagcgccctgtggcctccctggagaagcttggtgctctgcggacagcgtccccactggcaggaaaaaccactatcaacctcgaagccaaaagggacaccagacgtgcattttaatattcacgacaaggcctcaggtgacgagctactcacaggacaagcgttaacaattaatagtaatccacaaaacatttgggatttttacaacgacaaaacggcctcttctgtacgtcctagagcaactttcagggccactgaggcctaagtgatggcaggaagccgtggtgtttgaatgtgtgaaagcagcctggacttggcgtttccagccccgttcgctcccggcagagccccaagaaccaagggctggaggcttcacttcctgctccagagtggcaggtgcccaggctgtcctggctgcggtgcatctcacacaagaagcccagcgggagcacgcacagctctgggccttgcggcaaatgcgtaaccaaaaggcgtaaatcaagcttcgttcaccatggaggaacctcagaaccaccggcaccgatagccaagctgccagagaatggaacggacgccctccattggcacaaactccagcagccggcttgtcaggaagctgcagcagcttcagagcaacccaggcctcggggttcacctggcgcgtcaccgtttcccgagagccccccgcccccgcacaggcactgaggaccccaccacatgggcctgtgcctgcctggcaggaaggcagggaggaggaagtgggtcgggctggattgcatgtctgatgtgtgtccgatgaatgtccagtgcgtgtccaatgcgtgtctggtgagtggtgagtgtctggtgtgtgtctgatgtgtgtctgatgcatatttggtgcgtgtccggtgcgtggtgaggggcggtgagatgaggatgccagcgctaagcacaccccacaaacgggcgccgcgcacctggcatttaaccctgcacacttcctcaccaccctgatgcacagggtgggaaaccgaggcactccaacatctgatgaaacgaaactaaccccagggcttgggcagcagggctgagagtgcggcgtccctgggcgctgcccggtagcggggtgttcagttgctctgccaaaggctctgcacaagtggctcctctctctgtaactctgcttggcagtggggggctcggtggggggaggcccgtgctggctgggcacctgggagggtcccgtgaggcttctggtggtgctgacagctgtccgtggaaattgaggtgcttaaaattcataaataaaccagaaatccattcaataaaaagagataaaaatagcagaaagaggaagctacaagaaaacatacgaactccataaaattatcaccacagactggacgtgcccctttctaaatgtaaaagcggtttatagcaacacagcatggccctgctgcactacccctggggagcaagacctcctccagcctccacccaggaatttctccagcaatggctttagaaccttgctcctgaatcgcagcaggggaggcagcgctttggggccctctgtcaggctgccccccctgctaagaggagctgttgtccttgggaaccacgggtcccccctcctgaagaaggggaacgtcacactcacagttccattttacacatttgcagctgagaaccctggagccagaacaggctccagcacaggcgatgggtgagtgttttgcatgtctgatgtcgtttattctagtggttccaattgcctattttaatgtttttcttcttatttcatataactttttaaacttaaagtaataaagttattactaactttgtttcctgcgggtcacctcaagtctttcaggaaaccaggcaggacatctgcaggcggccggccagccttatcaacggagctctgagccaccaaccactgtgaccaagcttcattcccacgagctggacgagcagaaggcattgcagggcagtggggtccggagaggcggccgtgctacaggccttgcactcattttaatgaaggctctgcaggatttcaaggaaagctggagccagtctctgtgccagaatagagggttcgttcagcttcttagaccgatgatttatttagggaataagaagggcgattccagggacagtggaggcccccacaggaaggaaacctctccccacaatgactgtgcacagagccagcctgacacccaaggccacgatgccatagccagggagccctgaagaaactcctggaagaatgtaaaacccccagctcaaggaggagagtggaggcggttccccaccttctgggggcagttaacctctgagaatgaacccacagctaaaacccataaaacctccgccaaccacacccagacctggaaggggcacctctggccagggcgctcagcacgaggggacccagaacaatggcttccctggggtgcgggctcggcctgcaggatggaggctggagagctgccatcctagcgcacactgggtagatgcaggtgtttccaatgtgctgaagagggcagggcctggctgaggccctgggaggtcggagtcccggaggtgggtgggggtggtgagttcccaggtcacttccccaggtgtgcgttttcctcactgtcctgtcctattcattcattttagcacggaggccagaaccagccgagtgaagcccctgcctgaccactcaggggtgtgaggacaggggcgaggaccgggatcatcagtcagctcctagaatggcaggtttgtacctgcaaacggagcaccagagtgacatccccccaagacccccgagatgccatgagccccatggagaccacccacccggcaggggccagctccaggtgctgctgctgcggcgaggccgtcaccaccatccacgcgtccagcaggaagagcggattcctcgggcgtgaggctcaccactcacgttgtctgcacacctgcctgacgacctctcccgaacctggattcccaccacagaattcagctcctcgggtgctcaccagcccgtgacttgtggtcaccagaccggacggaaaacacagagaccatttcctgttttgcagaaaatcctgttgggccatgccagtcctagagccaaaacacggtgtccacttgagggtccagacctgaggccacccttgctgggacagcatctccttccctctcagagcaatgccactgatgcccagaccagcaaccatgcccgtcctcgcctgcccgacaatgcccttcccaggccctgctcctcggaggactggtcatgggcaccctggactatgccgacccgcagtccccagggaccaagtcctgctgctgtggacacaggtgaccctgcccctcgcaggggagctgctcttctcctgagcccaggagtgctctgaaacttatatcccaatgagaaccaaaatcaggagtagaagtgggagttgaaggccagagcctttttcgaagaacttccctaagctcttttaaatacctgcatccaggccagatgcagtggctcacgcctgtaatcccagcactttgggaggccatgccagaagcgccacttgagcccaggagttagagatcaacctgggcaacatagcaagaccccaactcaacagaaaatttaaaaattagatgggtttggtggcgcacgtctgcagcgaagcggaggattgcttgagcccggggttccaggctgcagtgagctgtgatcacagcactgcactcctgcctgagtgacagggcgagatcctgtctcaaaaaaccaaacacctgcatctcctgcatcttcagagcacagtcccgcctggaggagccgccgtcaggccctcctgcatcttcacagcacagtccccaggtgcagctgctccccccaacctaattcaggccctggtaagcttcacaaggccaaggggacgttggtctccaccaggaagactatatggcacgtctaaatgtaagaatctgtgacagacgtcgctgaagccaatgcgaggaggcgcaggtacccaggaggcacaggtacccaggaggcacaggtgcccacacgggccttgccgggggaagcacgactttgaagatggggacgtccacgtttcaacgctgccttgccagaggccagttccctcatctctcagcctcaggacaccgccctctccacagtgcagcctgcgggcacagagggcgctcggctggggaagggcagtggctctgcccccaaagcggcctccccaggacacaccactgcctggcttggaggtttcttcctctgccctgcacagtgagacaagcacatggcagggcctcccacacaccaggaccaaacaacggggagcactttcgatgtctttggcccccgccaggcgtggctcactggacccagaaaccacagcgctctctctctccatgactgtttcagctgcccatccccgttctagactgtgggaatagcagccaatgaagcaaagtcctggccccatggagccagccaaagagcacacagaaccacgaatgtccaacgcgggcaaggctggcgggggcagcactgtggcctcgctcgggggacagggaggcttacggacgagtgagcgcttgaacagcgctgtggacggtgaggagacccgcaggaggacaagggaacgcatgaatgaggccatggacggcgcggagagcgcaggaggggtctaggcagagggacaccaggtgcgaaggcctcgaggcagcagggcttgtgtgtggtaaagacgtaggagcaaggagaaggctgacgtggcctgggcagggcacggcaggaccggagcatgctgggagccgaggtcagaggtcagggtgcagccgaggtcacgtggtgcagagcagacatttcaccacagcagctgggaatatgcaggcccgtgcaagacactggatggacggatgcacggatggggcagtgggcatgcagggaggaatcacctgtctcaggtcagcagccaggagctgcccagacctggcacagtggaccaggaagggaaggtcacccaagcctccacaggtggggctttctgcaagcaaggtgcagcggtcagcccgagaggccacggtgccgagcaaatcctggttgtcctcatggggacgacaggaattcagttctggcagagccaagactgccgggaagccagaggggctcctgcaggaggtgacgggcctgcggggacgcgaagggccaggaccggacacgccccgttccgctctgcttccagtgaggcgagaggcgggcaggacgcagctggagccgcgcacgcccggagctcaggccaggactgtcccccagcgctgcgctcgcccgcggtggagctgcagtgttatcagtggtcagctcaagtccagtggcttgaaagggaggcagaggcctcaccttccctgaggctccctgtgaagagcaggaggctgggccctcgggaagaccccagccaggctctgccacctccacagccgggagacggggcctccaaagccggcagacggagcccccacagccggcagacggagccccccacagccggcagatggagccccccacagccggcagacggagccccccacagccggcagacggagcccccacagccggcagatggagcctgggcactgcacacagagacatttcttcttcccgagacctcgcacagaaattactcacttaaaagcacttagagttttttcattttttcagtggcaaatatttcgagggaataccacagaaatagccacaccaaaacccaactcagttctcccttctccacccccgccacggccggggacgctgcctcgatgcgcggggctccctccgccatggccggggacgctgccttgatgcgtggggcttgggttcttcaggtctcttgatgtttttcctcttagaaccgcaaactacggttgcctgaaaaggtttctaaaaaccccaggcgcccaggcccacctcagagaacggctctttaagggtgatgggttatgaaacaggagccctttgggaggccaaggtgggtggatcatgaggtcaagagattgagagcatcctggccaacatggtgaaacgccgtctctactaaaaatacaaaaaaaaaaaaaattactgggcatggcggcaggcgcctgtaatcccagctactcaggaggctgaggcaggagaatcacttgaacctgggaggcggaggttgcagtgaaccgagatcgcaccactgcactccagcctgggcgacaaagcaagactctgtctcaaaaaaaaaaaaaaaagaaaaagaaagaaagaaatacgagctttgaaatctatactagccatggagtctaacacgatccttaagcgaactgctcattacaaagcgtggcaggctgccttctctccagagggtttctggtgccctatccacggaggcggcagtgggattcagccgtcacctgtgcttgcggtggtaactccatctcagactcaacaggggacgtgtctgcacagagcacacggcgcaggggttgggcggggaggacggcaaggtcaagccagctcaggggacatggtgggcagggggctccagatcccacggtgggcagaaaaggcgggggtcggactgacgccgtcctggaccatgtccacgtctggggtctgcaggttccatctccctttccactgtgcctaaccttacatctataacctacatccagcaagacacgattttccacgatgagttgattcgtaattccatttatgtgcaagtttttagaattttcctgtgggttttttttttacttacttatgattttaattttgtttgctttaaaaaaaacacatgcataggaaagaatgcttcctttcatttcaattaaaaacaacaaattgcttttttttaagcaaaaattcattgagggggggctcgcattgtacaaagaaaatcagacccaccgggatggctgtgatcaaagagacagtaacaagggtagggaggtggagatgcgaatccaaacacacaacttgtgcaaaggtcaagtggccacagccgccacggaaaacaggctggcggttcctccgacgttcaacacacagtcgccacgggacacagtggttccacccccaggtgtgcagcaatagacatcacagcccacgtccgcacgcagactcggacacgcgtgctcacagcccacgtccgcacgcagactcagacacgcgtgctcacagcccacgtccgcatgcagactcggacacgcgtgctcacagcccacgtccgcatgcagactcggacacgcgtgctcacagcccacgttcgcacgcagactcagacatgcgtgctcacagcctcagtcatgacagccagacagtggaaacaaggcaggtgggcctcggctgctgagggagcaacagcagaacggtgctcagccctggagaggaaggacgcctggaccctggccccacaccacagcatccacaatgtggtgccaaccaacaggccacgcacacagaggccatgggccagacgcttccactgacacgaaatgcccaagagaggcacagccggcgacagaacggggacccgtgtctgccgccccaggagaggctgcaggccggaaactggaggattacagggcgcgagtgtcgttttagggagatgaaaatgttctaaaattggctgtggcaattgttgcacaactctgcaaatatactaaaaaccactgaattgtacatttcaaaatgggtgaattgtacggtgcttgaattatacctcaataaagctatttttaaagaaacaaaattttaaatacgtaaaaaaatcagaaagtgaaatctggaattaacattccaggaaacatcctcctggagttttttctccaaaaatataaaatagaataaaatatataaatgttataggtttaaaatatacaaaatataaatatatttgtattacatttataacataaatacaatatttataatacaaatataagtatattcatactataatgactcattatattataatacaaatatattaacaataatagtaaatatttatgttataaatatagaagatacgaatggaaatacggataaattttttaaataaaagtgaggttatgttccctgtgacagagtcagctttttcctttcacatcaggccatgggccactttccaaagagctgataaaacgctggggtcagacggcacgtgtgtgcgtggacagcagtgccaggtccccctgccatgtgcacgctgtgtggtgggagcagcaggggtgagcaccctgggaacgcagatctgtgcagtggctgattgtccccgtgggataaattcctccaaggatgtgcactgtcctgaggcctttgaaacacaaagccacagaaccctccagggagtctggaccagtgtccacccccagcatacgccgtcttataaatatttctacagtttgctaaaccggtggcaaaaacctgcttaaattttaaatgtctggctcattggtgaggtggaatgtccatctttttatgagcagttttaaatctcattttttcttgaaatgctctgggcctgttttctattagaatgaccatcttttcatgctcaggatttaaccctccgggaacttctgaatgtgtgttgcaacttaaaagacatattatttcacaacatttaaggaggatcttttttgaactaaaaaaacccccacaaatttgttaaatttgtcaccagtgggtgactatggacctgtgatcagccaactctgaaatgagctccagcagatggacacagcgtcccaggacctgcaggagcagaggctgcgaggccagccacgtccacctcgatcacgtcacctcgtgggcagaatggcctacgccccatgtcctcccagccccacccagaacccacggtgagcacccggcaggaagtggccacagcaccatcactggaggccacgcggagtctgaggacagcagctttcccccctatgctgttgtggggactccaggctcagcctgaggacagggtcagttccctccacacagcaccaacactcccaggtgcaaagcccaggcccacggacagccccccgctgtccgtgggtctcatggtgggggcacccattttctttcatcagcaggaaggtttgtgctttctccttcctgggcagcagagtttgaagcgtattccaaaagaaaaatgaaaccggctgaacgctagggcattcctcccatcccccatcctgttcggtggcctgtgccggacaatctcttctttctgatggactcaaaggggccacacagccaccaggtgccccccttcccatcagcagcttaacctcggggtatctcttggacaggccggctttgtctccagccgaggtcagcagcagtcagatgcgggatgaatgcctggcccaggcggcccccactcaccgcccgagggctctggaactctctttccaaataaagaaaaagtgcggcctgagaggaccaggctcgcctgaaatcctgccatgtggcctaaggaaattaacgcacgcagcagcctctccctctgaggcagagaccctggcaaagtctcctttccctcagtcatttctggaagaagtgcaaatgaagtttcacagaatcaagcaaactttcacggggaaaaaagaaaaaacctcttgcagaaaacagagttgacctttaagtagtggctctgatgaggggaaaccatctgaactgaattcctcctcctcctggagcctggagcaggggctcagctgggaccagcagagaaacccccgccttctcctccctgagtcacttcccagcatctgcgcaaggctggcgctgccccatcccgcctgcggctgctcccatcacgtgatcataagaaaataaacctggtttcccagctctgtgctctgccgcaggctcggggcccatttcccaaacgctggggggagccgggagctgccagggctgccccagcctcggggtagagggtaaaggctgcgtgaagaggaaccaaaccccaaaccgggtctgcgaagcagccctggggctcccaagccagcctctgggctgagctctgcggtcctgagtcactgcctgactcatcctcagaggcgccccacagagaaggggcaacttggccagggaaaatgctccatctccgcaaaggacaggaggcaaaacacacccatcagaagcacatggccagtgcagggccacacagccctggctcccacagaccgcaggctggagaatgggggtccgcggtcagctcatagcccacccgccacccagcactgcagggtcacacagccctggctcccagaggtcagaggctggagggcaggggtccgtggtcagctcacagcccactcaccacccagcacggcaggtctcagcggaagccccacacacactgggttgcagcctcctgtggttcaagatgggtggggttattttgaaatgttggcaaatagagctgtgagtcttcaaacggaacccaaagactcagtgaggaaagcaggcgggctgggctgagactcacagctgcagcggccgtggtgagccacctcacctccccgagcctcagtctccccatctgttcaggggcaccgaggagctgcccctcggctcatgggctctgtggtcgccaggcacgccacacaccacacgccacacaccactgcacgcagcaccccgggacactgtggcctcggctcccgcctctcctgcacatgaggctctttcctctctcccaccccataccccccaaaaaagaaccaccatccttacaaacaaatgaaaatcggctgggtctttagggcccggccacgatgtgtgactgcagcagtgactctcaggaggaggcacaaccagacaccgggtcccctgcagcagctgagacacctcaaaccccaaaccctcagtgaggccctggtgggaaaaggggctctccagggaggtgccaggggcaggagagagggccagcggccgaggagcgggaggcggccgggcgagaggaggcccgggcaggagggagaaggggggacctggcctttgctcctcatgggatcctcggtgcggccccctcgtgacaggcccagcctctccctgcagtggcccagccacagctcagggccaggaggctcctgcaggcacaggcggccgatgagtcccttccaggcctgggcctggggcagcctgccatgtgcagtagacactcagtactcacagaatacgagcaacctcatgctctccgccggctgagttcctgtgcggctgagagaaccccctgcatcattctgacacaggtgcgctcctgtgagccagcatgacacggaaggacacacacatgcaggtggagatggagatgctgggccgggcttgggggtcatacagacaggaccaggggctctgacctgctgggagatttggggccagcattccaggactgagagaacagatccctggcctggggtgctctggggctgaggatgggcccccacctgggctgaggatgggcccaacctgggctgaggacgggcctccccacctgggctgaggacaggcccccctacctgggctgaggacgggccccccaacctgggctgaggacgggccccctgacctgggctgaggactggccccctgacctgggctgaggacaggccccccaacctgggctgaggatgggccccccagctggggcactctggggctgaggacgggccccccacctggggcactctggagctgaggatgggcccccacctgcggtactctggggctgaggacgggccccccacctggggcacttctggggctgaggatgggcccccacctgcggacaccccggggctgaggatgggcccccacctggggtactctggggctgaggatgggtcccctactccagcagttctgggatattctgggcttcaagaagcctccagtcgtgtcaagcaggtttttgtttaagctctaacttgagagtgaaaataaatgttcatgggaaatgtgacttttcatgagtcgcctaatgtcaaagtcggtgtttcctaagtcagcaacttggtttttattaaaagcatctgagagaatgaaccgtctgtctcccaaaccaccaacttcctcctgcccctttcagtttctaaccccaaataacttctcccctcccgaaaaactttggagctgtggagacatttcttggtttagtcatttctactacacaaaagtactattttgggggtgatttacatcttgcagtatgaacagaaagaaacctccctgtctttaacaaacacccactgcgtgcacacaggacgggacgggcttccacccagaagagctcagagcctgcccctcagggctgccaagtgagggtccctggtgatgtctgatgtcctcgtctgcctgggaagacccagctctcctcgctcagctctagaagatctatctgttccttgacttgtaacttctaattgtacataaaacacacaaacaaaagaacaagaactcccccataattccacttctcagaaatcacatcacattgacgtttttgtctgcgtatccagatcattttgggggtgctcatgattttttaaacaaaagaacttttcctacagacacagctttgtaacctaacgcataaccagctttcggagcaggagttcaggccgtggcacctctgggtggagggggcacagaaaccagccacgcctgcagtttcttcctgttgtggccacggccccttctccccgagatgggcatgcaaatgaaccctgcaaaggacgcaggagcaactccacagaaagggggggccagggctccgcgtggggcagagggctttgcccagcctcaaccccagtggcagggggtagggtcagacccagaaccctgaggcagagcctccctgagccaggactgtctgcgtggatgagggtttggggagaggtcagccacgtgggcgcagaggaagcaggcagggacagacaccattccacgtccttacgtggatggaaggaaatgaggacacgacacttactgaatattcttgcaaatgactggactaacccagcaaggagagatttaggttctgttgtgtgtgacgccagctgttcctttctgctggacaagacggtgatttccactgcagcgcagccttggggagcggggtcatctccttgttttagggtcgtgggtgccggcccaggggaggtccagggcgggaagctggttcccaagccccagccctgccaacccaatttcagggagccttttagtttaagtaaataaggaaacaaatagtggctgccctttaaatgattaaaaatgattgctctaaaaggtatggattgtgaacacagttcactctcaacctcagaaaattatttttctagtaggacagaaactgccaaaatcacttccttggagaagggccaaggccagagagaaagggcttgttctctgaaatgtgtccacttcgatgcgttctgaagttaaacctgtgacagacactgcccttcaacctccaccttgaaaaatacagaaaaaagggaagacagaggacgctctccccagacgtcggctcagcactcgataaagaggccccacagactccagggcctcggacgcgcggcccaggggcccgggccacacgcagggaggaggcgtgggggacacaggcctgaggtggagctgggtcggtgacctccttagtgggaaagagggaagaagagaagctgagttccgcctttccttcctcacacattccatttgcagcttcctgctaagtcagacggcgatattgggcaacagcaaatcaaacttgacccaagtgcttctccccagggaatgtgagaaggggctcctgcccggctgcagacccagcggccagagagcaccctggggcccttctgagctcagagatgcagacgtgggcttttttctttccacagcgactttgccaaatgaaccatcagaccttaaaggtgacactgaccttggaggaagcacacggggggctgggagactcagggaccgggagacttggggggctgggagactcgggggccgggagactcgggggaccaggagactcagggggccaggagacacaggggccaggagactcaggggtcgggagactcgggggttgggagacttgggggtcgggagactggggggtgggagactgggggaatgggagattcggggaccgggagactcggggagccgggagactcggggagccgggaaactgagggggccgggaaactggggggccaggagactcggggggccaggagacttggggggctgggaggctcgggggctgggagacttggggggctgggagactcgggggccgggagacttggggggccgggagactcgggggctgagagactcaggggaccacttggggggccaggagactcgggggccgggagacttggggggccaggagactcaggggccgggagactcaggggtcaggagactggggggtgggagactgggggggtgggagactcggggactgggagactcagggagccgggagacttgggggaaccgggaaactggggggccgggagactcgggggccgggagactggggggtgggagactggggggtgggagacttggggactgggagactcggggagccgggagacttggggggaccgggaaactggggggccaggagactcgggggctgggagactcaggcggccgggagactcgggggttgggagactcggggggccgggagacttgggggctgggagactggggggtgggagactcgggggatgggagactcggggaccaggagacttgggggaccggccccaaagtgggtgccaccatggagcaaggagggggcggtggccaggactaaactccccagcatgtggggcagccctgcctgacacctgcctctcaggtggatgtcgaccaatgactaatacaggactctgttaatgcatgtgcaccgatggagggcttccgaccacagatgtagcgtggattccagctgcaagtttatgagagagccagcttttgggttcaagtacctttcctgccaactttttgtatggggtgggttgatttgcgttttgccctcacactacaggggcggccagcccgcacagccctccaaatggacagggctgccagcgtccacactaaacggcgccagtgttacacgtgggcagggctgccggcgtccacgctaaacggctccacagtcttacacgtgggcagggctgccggcgtccacgctaaacggcgccacagtcttacacgtgggcagggctgccggcgtccacgctaaacggctccacagtcttacacgtgggcagggctgccggcgtccacgctaaacggcgccacagtcttacacgtgggcagggctgccggcgtccacgctaaacggcgccacagttttacacgtgggcagggctgccggcgtccacgctaaacggcgccacagttttacacgtgggcagggctgccggcgtccacgctaaacggcgccacagtgttacacgtgggcagggctgccggcgtccacgctaaacggcgccacagtgttacacgtgggcagggctgccggcgtccacgctaaacggtgccacagttttactctcttggaactgtcccacatgggtttctctttctttgctatcagtcttttgttgtgtgtgttttgggtttttttgagacaaggtcttgctctgtcgcccaggctgaagtgcagtgatgtaatcatggctcactgcggcctcaacctcctggcctcaagcaatcctcacacctcagcctcccaaagtgctgggattacaggtgtgagccaccacacccggccagaaccatgatttctatttctaaattcttctgaaatatctgaaagacaacaggcccccatttctcaacctcacctgaaagagaggttcccaaacagattctcctcccactggctctgattcagcgggtctgagaggatcccggcctgagaaagactgccagtaattctccaggcccacaatccataggcctctaacaacagaccatttaaacacagaatggacttttatccagggaagctccaaaggcacttctgaagggctcggtctcttcccattttcttcagaagaatggctgtgcccagtcatcgccatggcaaccccaagacactctcataaagccagactgggcgcctgacaatgcccctcagcctgcagttctttttgacgagttatttcaaagaacccggagcgtgcattaacataacacaaatgactctcactcctcggcctggagggcagctgcgccaaagccttttggaagcactgtcagtgacggagtgatatgagccccagtctctccagggcaggagacccctcacagttttctagtaagtaaactcacccagtcatcagcatgggttgttcattcccacttggaagtagccagatgcaaggatataattctttagctaaacatgttctcaaaatcaaaatagctgttttgatcaaagcacacgacccatgcttctgaactgaacggtgcagtcacagctgcaaggatgtcttctctgatccccaagccgctccttataacccggtggagtcacagctacacggacatcttctctgatccccaagccgctcccttataacccagccgccccatgcttcccccgaggccgcagcactgaggccctgcctggcacactctccctggcttctctcttcccacccccgacataaatcgccatggcttcctgtccctgtgcatcccaccccgtgccatgtcctggtgttcaactgcagtggtcctccgagtacggcctggccacttagctggagcttttcagaaacacaagttctggttgtgctctggacatcctggggtcggcacccacatcttcacacgctcaagttgagggggaaacttgttgattttaagagtttgtttttcttggctgactcctctcttcctcaaatcatatcaataaacactttctaggcctcttacctcagttaacacccatcttctgtatagctattttagaaaattttacaggaagagaaaagctttctcagtatttccccctctcgaaatccttaatttgtactcttttgtggagtgcgagcttcccggttcatctctaattaaaaagcactcgtgcgagtccacgcagggggaccgccgcctacatgcacttcctggacagcgggagcatttagccaacaccagttcacatccacgcaccaccaaggacagaagctcagctgcctgcacaccagagccccagggagcatctcctcctcaaactaagcaggaggaaaatgggaaggtgatgtacatgctcaggacataatctacatacagaaaaattctctacacgcgggaaaataggatggtgacgtacacgctcgggacactgtctacacacagaaaaattctctacacgcgggaaaatgggacagtgatgtacacgctcaggacattctctacacatgggaaaatgggacggtgatatacacacttgggacattgtctacacatagaaaaattccctacacgcgggaaaatgggacggtgatgtccacgctcgggacattgtctacacacagaaaaattctctacacgcgggaaaatgggacagtgatgtacacgctcaggacattctctacacatgggaaaatgggacggtgatgtacatgcttgggacactgtctacacacagaaaaattccctacacgcaggaaaacgggacggtgacgtacacgctcgggacattgtctacgcacagaaaaattccctacacgcgggaaaacgggacggtgatgtacacgctcgggacattgtctacgcacagaaaaattccctacacatgggaaaatgggacggtgatgtacatgcttgggacactgtctacacacagaaaaattccctacacgcgggaaaatgggacggtgacgtacacgctcgggacattgtctacgcacagaaaaattccctacacatgggaaaatgggacggtgatgtacatgcttgggacactgtctacacacagaaaaattccctacacgcaggaaaacgggacggtgacgtacacgctcgggacattgtctacgcacagaaaaattccctacatgcgggaaaacgggatggtgacgtacacgctcgggacgttctccacacatgggaaaatgggaaggtgacgtacacccttgggacattctctacaccaaagaaaacacatcagtgccaagtaaagcaacagaagacattaccagagtgacttttccacaattttggtcctgaaaacctcctcctggtccaggttcaccgtgcagtagcaatccctcatcttgctcggccccgggtaagagggaaggtttttggcttcacctaaaaagtaaaagcgacatacatcatcagcagcgtagaaatgtttgttccctgctacatcgcagacacgtttccagcctttgcttgtgtgcattcactagctctctataaagccttggtttttttgccaccacaagtcaaaatgtggatgtgcaccccatgtgtactgccgaaaggcgagggacatgcacgccaccctctaatgcaagtcccgcaagcagggacctgccagcctgggactcaggattgctgtgtcttgtttacctgcattagtccctttattttaatttttaacatacaattttccatctctgacctgctcgcgtgcacagttctgtggcattaaccacgttcaccgagttgtgcaaccatcaccaccgtcctctctggaacactctcgtcttcccaaacggagactcggtccccattcaacactcactcccatccccctcctgctgtctcccagtggccctcaccccactttctgtctctgtggatctgactactctggggcctcacgtcggcgggatccacaggacgtgtcctttcagcccggctcactctactcagcaaatgtcctccagggtggcccctgctgtggccgctgactggattcccttctattttaaggttgaataacttccatgatgcaaagggacctcgtcttgcttattcatttatccactgagtccctttttattttgaattttattttatattaggtcaaagttggagccagaattaaaggaaagagctctttcttgtggacgtgagttaactgtaaactccagctgttcgaattgccagtaaagagaagcgtcccagagggacctaagctaggtccacctctccctccttcaagcccacagagacgccacctggacgtgcttgaaggaagtggggccagttcctggctggccctgcagaaaacgcccgtgatcccggactccttgtttgccaggggtcagtctggaggtcataactgaaccccagctgcgacttctctgctggaagctcggagcatgccccagcggcaagcctaacggcccagtttactggagaatagggagtgagcaggaagggatgagtgacagctgtcaatccagacagcggatgcccagtttaagtccattctgtaaaaaaaacgcctcaaacacactcgcgcctccccagggccttttctgcctccgtcatttggctctaaagacgcctggcagtggcgtctccacgacgcaggatgagaggacagatgcaggcacaggcaccacgctgagaccacaccaaggctcctgctggcgccactcagggccacatcaccttattcttgttgaaacaaacaaaatcaaaaacgggagcagagtagaagtttctcagaaccccacttccgccactccgcgctgaatgtttcgcgtcaactcagcaagcgcacacgtcatggctcacatggggcagtcggctcatttcaaagatgccagtttgcaaactggcatgccagcaactccaaagggcagagataaactcagtttgaagctttttaaagacttttcatccacaatattaacctgaggcactgtgagaaggagcagaagccccagggtctggacaacgcctcccgtgtccgcgccgcgtatctctgcgtgtggaggcaccggcaggacgaagcctcccgtgtcggcgccgcgtatctctgggtgtggaggcgccggcaggacgaagcctcccgtgtccgcgccgcgtatctctgcgtgtggaggcgccggcaggacgaagcctcccgtgtccgcaccgcgtatctctgcgtgtggaggcgccggcaggacgaagcctcccgtgtccgcaccgcgtatctctgcgtgtggaggcgccggcaggacgaagccgcccgtgtcggcgccgcgtatctctgggtgtggaggcgccggcaggacgaagcctcccgtgtccgcgccgcgtatctctgcgtgtggaggcgccggcaggacgaagcctcccgtgtcggcgccgcgtatctctacgtgtggaggcgccggcaggacgaagcctcccgtgtccgcgccgcgtatctctgcgtgtggaggcgccggcaggacgaagcctcccgtgtcggcgccgcgtatctctgggtgtggaggcgccggcaggacgaagcctcccgtgtcggcgccgcgtatctctgcgtgtggaggcgccggcaggcgttcccagcagcacccgctgctgcccacacggagcagctctcagggtctcactgcttgcggccgtttcccgccagtgcccccaacacacagtctacctctctgggcctcaaagtcctgaactgcaaaagcaagagacacagcagctctcgaaggctcctccggctctgagacgcctctaattcaaaaggttctggaaatttttattttgggaatcattaaggaagcatcaatgataatcggttggtgggaaaaaatgagtatttcctgataggcactggaccctcagaacacctcaacacggcgactctcccgggatgcgccttcttcacccgctgcatgggagaacacagctaggctgctacgaggcacctggctccaggccaggcctcaggtcggtcatcccatgtcagaagacaggctttccgaaggctcccaccgatgtgaagatcccacacgcagcacacgcacacacgcagcgcacacacgcagcacacgcacgcaggcagcaccgcacacacacgcagcacacgcaggcagcacacgcacacacacgcggcacacgcaggcagggtgtgtgatgagttcacaggcacgaaggggagaacatggccggcgagcttctccagagagggaagggagcctgggggatggcagttgaggttcccggagcagacgcagccttcctggtggccgcggctgcccctgaatttgagggcagccgcagcacacccagcaagtcggacaggggcccctccagcctcccggccctgttttggaactgacggcttctgcagcagatagaagtccttaccctcaaacacagcttgactttgctgactttccttctgacacctttacagtgtgacctgacgctgaccatatttcccttgggattttactgggttttttgtttttgtctttgggagttttttgtttttgttttgttttctgggatttctttgttttttgcaacaaatgagtgtagatatttagctgtaagttcctgtgtttcttaaaaggagagagaaaaaagcttttgaaagtcctgtgggagatggtgtttgtggataatacggaactgagatttgttcccacagggcctcaaatcacagcagtaacagctgggtcttccgaaggcggacactgcaggacggaaacacacaagctttctgtggagtccctgtaagacagacgccgtacgacatgaaaaggccggatccccctgcgctggcgccaacacaccagattcatccctccctgcctgatgatgcccagtcccaccgcactggcaccaacgcaccaggttcctccatccctgcctgacgatgcccagtcctaccgcactggcaccaacgcacccaattcatccctccgtccctgcctgacgatgcccagtccccccacactggcaccaacacaccggattcatcccttcctccctccccactcaatgatgcccagtccccccacactggcaccaacgcaccggattcatccctccctccctgcccgacgatgcccagtcccaccgcactggcaccaatgcaccggattcatccttcctccctgcccgacaatgcccagtccccccacactggcaccaacgcaccggattcatccctccctccctccctgcccaacgatgcccagttcccccgcactggcaccaaggcaccgggttcctccctccctgcccgatgatgcccagtcccctggccccaaaacacaccaggttcctccctccccgcccgatggccccgtctttacctccttctccttgctcactgtcatctggggctgagactctttctttttaatctacttttgctatgatgcatttaataaaaaaaaaagtggggggacaaaatgcaagcccatttccctgcctcaggcttctgatgccatcacctccaaggcactggttttgtttccaactgttaataaagcattgaaacagaaaaaaaaaaaaaaaactcctgagaaacatcctggttgctatgacgacagcaacaccagggagcctgctggacgcaccaacatccaatgagctgctcagaccaggagggctggggctgctgcagcacggcctggccacgtcgccccggggcctcgccgtgtgtgccacatgcaccaggaccgagcctctccctgcagccccacagctgagcgggacgggggctgccccagctcccaagcaactgtttcttctccaccgcaccccaaacagttcattcagttaccttcaccaaaggtgcctgttctgtctctcttagaggaaacacgttttctcttttttttctggtgcacagagacgttcatataaaaagacaaagctgtctgtggtatacagtaagtacctaattatctgttgcatgcatggatgaataaatgaattaaaagaaaagtaaactggtttcatcctaacagccaaataagtaacagttctcatgaccacttttcccacagaccatgcctctaaaacatatgcggtgtgttcaccagccggcagactgatgaagacagccaacacagcacctcgcatcggctctgaaaactcaactaacaggagtaaaaggcagcacttaaacacatttaatgtaaacagcataacaccgcaaaacctgatttccaactccagggatcaggcagtgagtaacaaaaacaaaggccctgatccaaagcgtcatgactcccacgcccacggcagcccttctgggccatggagggaagctgcaccctcagggtgagcacaggcccagccctgaccgagggttaggatgcccaggcttccctggaggcccacacagggtctccaagtgctgacagcgagctgtcggggctgcccgcagcacccggagccacacccctgtacccaggaggagctgtgagggcatggggaggtctccacagaccccacccagcactgctcctccctgcaggcatcctggggagggccctcaggcggggctggcctcatgtactgctcaacacagcagcgggcgtctcccaggcgctcagcagctcagctcagcgcccagtgaagagggcggaggaaggaatgaaggcagccacgggtgaggacgagggcccagggctccactgagcaaagctcctggcaccaacccagacagaagacgtcctggagaggccagggctgtgctggtactggccgcgtccacccaggctgggcgctcttctctttcccacgtcatcacggcgttttactcaactacaggtcggcctcactgaaataacgtggaacaggtgatggcgacagccccggtgcatggtccagcgaaagcaaccccgtcccagcaataaagcccagggcctgttggggaaggagaccctgcgggagaattggaggaagtgcggctctcaaggctcccaacctcagccttttagtcgtcccaacgcaaaacattcaaaggggcctaaaaattttgctaggcacacagcgtcttctaacaacataaagtatttaccggaacaatagtcttgtgactaaaatatctgaataaaggatgaagagccccgtctactttgggctatttagaagcctggaacagcgatcccagccctggcccctgggatcctcactcgaacaggtcctcctccaggccctggcagggtctcagtgaggcacagaagcctctgtgccatgcgtgggtagagacccctctccgggctctgagctgctgactgcaaggcccatgtgccccctggctcctgttcgcctctggacacgggggctccgtgactggcctctgagtgggcctgagtgcccgtccgcactggcctccccacccggcaccctccgtgggacgaggctgcacatctcggtgggctgactgcggtgcagaggccataagaggaagaggcgggggggccccgaggcaggggacacagcgtcttgaggacacagcatgaccctgacccccacgacccctggcaacacaagtgccttcccgaagggcctgcgaagctgccagaaataggcagaactcggcgaggccgtgggagtggggtttcctctgggccgagtcgagggcagacggcacctgctctatcctcacgctcaggaggggcagaggccgctgggcttggatggagccaggcccaggtcttgtccagggctctccagggcaccatgctcctccctcaagaggactcctgtgggttatgaatgacagaagcccaggctgccatcctcaagcaaggcaccccccaatcctcctggccgggaggggctgctgggagcccctggcaccagcgggcttctgtgggcggtggaaggaggagagggctgtgcgggctgattccaaaactcactgggtgacaccacctgcccagggagggcccagcactgccgtccagggggtctgcctgtcgtccagtctccttgagagcacctccagctccctccagtctccacggctcttcagagggcacgggaggttctgctgaggggcgggtgaccaggcccagatgttaaaccctcccaaataacgggcatattcaatgtaattgaaacttccaccacagggagaatgagtctatggtgacggggtggcaggaggggtcctagaaggcgcccactgtgcttactggaggcctgaccccgacaacggctgaaacaggggtctcccccaggggccactgaaacaggggtctcccccaggggccacctcccagggcacgcttggatttcactatgggctgtgcaaatggcatctggtgggcagagtgcagggtgtcttctgttcagtgtcctgctgcacacggtgccccagggcacagggccgtccacctagaacaccaatagtgccgtgtggcagagggccgtccacccaaaacaccaatagtgcccctcggcagagggccgtccacctagaacaccaatagtgcccctcggcagagggccgtccacctagaacaccaagagtgcccctcggcagagggccgtccacctagaacaccaagagtgccccacggcagagggccgtccacctagaacaccaagagtgtcccacggcagagggccgtccacctagaacaccaatagtgctgcgtggcagagggccgtccacccaaaacgcaacagtaccccagttacacgctcctggtgcaaatgaccctcctctcgtgcttggtgcaaaggctgttagcaacgggccacacaggagatgctgccacgtcactccagagactcacgcgtcccgagacccaagtgatccctaaacgtctaggaggagacctggccttggagccaggtcagccagaaggttgtccaggccgggcctccccagggctgcccagtctcccgatgcagtataactctcaaggcgcgggggccgcatcacccagcactctggaaatgctgtccgcagaccacggccaccagcacatgcactctcgtggttctgactgcctgtgaatccagctggtctacaatgagccgctggggaaaatacttcaagtcctgagatgaatggagcaggaatgcctctggaatatcctgagaaacacgactccaaaccctgtcagctggttctaactgtgctcactcttataaacaggtaataaaatatgggaaagaaggcgattgcagacaggggacctctcctccacagagacgtgtccaccaggagactgaggcaaatcctatgggttcaaaaccgaagtttcactggcggctgaaaacacccagggaataacgaggaaagagaaggcaaaggtgggctgaaatgaagccgcccttctgagttcacaaaggagcagagacacaccggtgctgcacaggaacccccagggcccccgtgttcctagcgcagcagagcctgccccgcatccaggctgcatctcctggggctgtgactcctctcctgagtccacacacaggacctcacacctgcactcaccggctgcagctgcacacacaggagagcttctcacaggacaaatgcctggaccccacccagagattgccattctttgactaggacgggctccaggcagtaagaacagacattcgtcttgattagaaagcctgcaggtggttctgggtgcagccaggactgagaggcattacttactgctgagaactgagaaggtgtgaagatgcccctacctcctcgccccactcaccggggagctgcgggtctcacaggggcaggcaggaggccagagacgtccacgtctgagacaaaggacatcaccgcaacagcagagccagagctgcagcgtctgcaggtgccctggtttgcctcacgcagtaccaaattgggattgggaacccagtgatgcctgcacacatatcggctgcaccttgggagcagggcctgagcctggggaaccctagtctcttataacgggcagtggcaacaatgctgacatctgcctcggagagagatgctttcttcctgatcacggacagtgggcaaacctccctgtgctccgaggctccgaggctgctccccgggtggacacacgcgcttgaatggagagtgaggaacaaagggaactgggtctttctcccttgatgcgccgcactgagataaaaccatgaagaacgtctcccagctgcgtcccgtctgggggcagccccagagaaggaatggggggcagggaaaacaactttccttaacccaagcaacgtttagttcacacccagcctgtacgcaagaggggaagggacaggcctggggctgcacccccaggtgggtggtcccaacagaggtttaacaacctggttctctaggggaaaaatgcatgcacgagctcaactaggttaagtcatacattgcactagtgtaaaagatgtgtagcacacaactcacaaaaaataatgagatacacagtcctctacttcaaactcacagagctaattgattctcacagcaaactcttgtctctaagccaatcctgggctgcatttaaccaggatttgacaaacagaggcaacgcaccctctgctagctggttctcaaaaagtgcgtcatcactgagtgtgatatgtgtcgaccattaaaacatttctcccactcatacaaattatattaagctgacatctcttctggctttcacactgggaatgctggcgcttcactcattcatcaatgtcacaagcaactttgttgaatcaggtgaagttttaaatgccagaaaaacattgtcttaatttttttgtgctattgcagtgtaaccgctatatacaagattatttaattcagggtagcaagattagatgatcaacaaaacctttgttcaaacgtgagctcaatttcctccgatgtgtggcccatcctgatttctgtggtgtgaacattcctggccgatttcaagcgaccagtgtggccccaaagccagagagaggagagcagggccccgttcagaggcacccacacctccagaagcacccagccagacagcctggagcccagcagcaatggcgtgccgtgaaatcacaggaagtgctgagtctggagtatcgactcccttcgtcctcgcggggaaatcacggggaagtggtgagtctggagtatcgactcccttcgtcctcgcggggaaatcacggggaagtggtgagtctggagtatcgactcccttcctcctcgcggggaaatcacggggaagtggtgagtctggagtatcgactcccttcgtcctcgcggggaaatcacggggaagtggtgagtctggagtatcgactcccttcgtcctcgcggggaaatcacggggaagtggtgagtctggagtatcgactcccttcctcctcgcggggaaatcacggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcctcctcgcggggaaatcccggggaagtgctgagtctggagtatcgactcccttcctcctcgcggggaaatcccggggaagtggtgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcacggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcacggggaagtgctgagtctggagtatttattcccttcgtcctcgcggggaaatcacaggaagtggtgagtttggagtatcgattcccttcgtccttgtggggaaatcacggggaagtggtgagtctggagtatttattcccttcgtcctcagcgtatgtgatgggattctgaatgggggctgtgtttatctgggcataaaactcctgaagattggcagcaggagtccacgcagagacctcctggagatgggcgcgctacacgagcttttgaaatgagcaagtttccagagccggcgggattgcgggggcacctgggaaggcaaagtcacctgcacccgctctgcagccccggcctgcgcctctggagggagggccccgggcagtgccagcaggaacgagcctgcctcagagccccaagtctcagtggagctccttccaggctgacatggggctgacggctcccggggccagcagggcgcccgcccgacaccaccacaacccatttcagtgacagataacttcagacaacttatcagagggccttggagggccggaggcagcaacacacacagcctgattctgggagcagcatttccttccaaaaaccttaaatcggataatgagccgggcgcggtggctcttgcctttaataccagaattttgagaggctgaggctgacggatggctcgagcccaggagttggagaccagcctggccaacatagcgaaacctcatctctactaaaaatacaaaaaattagctgggcgtggtggcgcacgcctgtagtcccagctatttgtgaggctgaggtgggaggatcacttgatcccaggaggtggaggttgcagtgagccatgatcacaccactgcactccagcctggatgacagagtgaggccctgtctcaaaaaaaaataaaaggaaagagagacacatcagtcacagatacacacacaacaaatctaaaatagacatgtgaaggcctacacaattaaggaataatattttggaaatgtcaatgattaacgtgcctttagacttaaaaaattctgctgtgtgacttattttctaacacctcagctgcacacccttgagccacagttctgctcactctcagggccacataaggaaggttctcagtcttccccgccctggagctcccagccatttgctctgatcccttctacagcaattctcttgggctccttcaagtgtaagcctcttgccccctagggaaaggaatgcctgaagaatcacacttcgacttccttatctgaaggccatacttgatggatttgaacagatttgcacatttaaattcccaaattaattttttttttttttgagacggagtttcacttttattgcccaggctggagtgcgatggtgcaatcttggctcacggcaacctccgcctcccaggttcaaacagtctcctgcctcagcctcctgagaagttgggattacaagcgtgcgccaccatgcccagctaattttgtatttctattagagacaaggtttctccatgttggtcaggctggtcttgaactcccgacctcaggtgatccaaccgccttggcctcccaaagtgctgggattacaggcgtgagccactgtgcctggccctaaaattcccaaattaattttcacatggtaaaatgttccctggttactaataacaataaataagattatggaaacaaagtagagacgatccgtaagaaataaatagggattaaaaactccaccatatatgaagttcataattaccagcacagcggtgcagggacagcccccagctcctcctcccagggcagcagagcctggcgagtcccgaatccctggtggagctcccctcaagcctcccagcagggctctgtcccctaagccttctgctccttcgctccttcctgctgcactttctgctacttgcacagcaatttctaatagttctcattagaggggcagagcagctgaaaagggtgaagaaaataagagaccaagatggcagggatgttcggaggaggagagaggaggggagacgaggggagacgaggggagacgagcggggaggagggggggaggaggggggagggggaaggggaaagctgcagagaatgaaggtgaggacctggtggaaacctcacagagggtgatttgaatacaacctgatcttccctggcatggagggcaggaggcggccacctgagccccgcacaggtgcccggcaagcccaggcagaggaccaagcagaaggtgctgtctgatccagccgcagaactaaggaacgcctttagcccctgctcccagctgcagaagagttgcccggtgacccaggaagcaggaggaaagggcaggcctgggccagccctgcacggacatcagccctgcacagacatcagccgcgcacggccgccccacagcctgcacacaggtgttcacggcacgtgtgtgggtgtcttgattgacaccacacaactccctgcttttaaagggcacgatcccgtggtttttagtgtattccgagttgagcaaccgttatcacgattgacgcgagcatttccgtccccctgaacgaaacccaccctcctcccccagcccccggcaaccacgagtccactctgtgtctctgtgggtctgcttgtcctggacatttcatggaatgggaccacacggtccttccccttctgtgcctggctgctttcactgaacgtcctgtcttcaaggttcgcccgtgcttagcccgtcacagctctgcccatcttcctggccagatgatatttcatgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattatttaccaacgggtggggccgcacggcaacaggtttaattaccctaggagccacccggctgcctgcccagggccgtgccttcacacctgcctgcaaagcgcaagcgttaccatgtctctacaccctcgtcagcacttgttactgtctttttggttatatatttgctttgagtcagagaaatatctgtctttaattttgttttgttttgttttatgatggcaaaatgggggtacatgattgtggcaacagttttgagacagttaatatttttggtgtaagaccagacagatgaagaaactgtctctgaagagaagggaccgaggctcctccctgcgtggcagcaaaaggtccacaacacatcactttgggtctcctgtcccaggagattccgcttccgaccaggcaggcttgccccctgagctcatcacagcgtgagtctgggttcacattgcccacactggagcatgggctgtgaaactacaagagaaaaacacctcacagcagagagcccacgtgacaagcacacatgcctgacgggcacgggcgtctctgcagcaggctcaggcagtgaacacgcagacccttgcttcctctaaattcacagggctggccctcaggtatgcgtaacaaaaagaacgccagttcccttttcctggagaaaatacaagaggttccagagccttaatctacaactccagttcaaagtttcaagtagaaggtggagagaggtgggaacattctatttttgaaggtttccctataaaatctgttacatacatatatatgtatgttttttggtggtgttattgttcagtaataccagaaatgcatggtagaaaactttcaactataggagtccaagattaaaaattaagagtagccctaaagccccatgcccatctgtagacgcactctctagaaataaccacagttactaatttcttagttttttgagctagcatttcaactttaaataacagtcccattgctatttcttagatcaacttaaaatcagctgctggctccctgctgtgaaagatgaagggtctggggccacatgggtccccctccactgtcatgtcccacatttcagtggaaaggcttccgagatttccccatttggtgtgaggtcgtgtcccagatttcagtggaaaggtttctgagctttccccattcggtatgaggttagctatggttttgtcatcaacaggctctaccattttgaggtatgttcctctatacccaatctgttgagtttttgtcatgagggatgctgaattgtatcaaatgcttttccagcactgactgaaataatcatggtttttgttctgggttatatccatgtgaccgatcacatttattgatgagcaggtattaaaccatccctgcattcctggatgagtcccacctgtcatgctgaatggtctttctaatgtgctgctggcatctgcttgctggtgtcttgctgaggacttttgtgtctgtgttcatcagagacattggcctttagttttctttttgtgttgtgtccttgtctggtttgggtatcaggtaacactaacctcactgcttgagtttggaagtatccccttctctccatttgtttggattagtttgaatataattggtattagttctttaaatgtttgaatgatccatcagggcctgggctttttctttgctgggagattttttgttctgatttctacgtctgttcaggttctgtttctttatggccccaccttggtaggttgtatgtgtccaggaatttataaaatttctctaggttttctaatgtattggtgtatagctgttcataatagtctctagtgagcctttgtatttctgtgctatcagttataatgtttctttttccatccttgattttatttattggggtcttatcttttttttttcttagtctagctagagctttgtcaattttatcttttcaaaaaaatcagcttttcattgtgttgatcttttgtctcttttgtctcaatttcattcatttctgctcggatctttgttatttctttccttctactaatttgggggttggcttcttgattttccagttccttgtggtgcatcactaggttgtttacttgaagtctttctacttctatgacataggcattcattgctataaatgtccctcttagcactgcttttgctgtatcccataggttttggtatgttatgtttccattttcatttgtttcaagaaattttaaattttccctcttaatttcttccctgacccactggtcattcgggagcatgttgtttaatttccatgtgtttgcatagtttccaaagttcctcttgctatggtttctagtttttttgattgtgttgagaaaagagacttgatataattttgacgttttttaattttttgagattgttttgtgagctaacctatagtctatcctggagaatgttccacttgccaatgagaataatgtgtattctgcagctgttggatgaaatattctgttaatgtttgtcaggctcttttggcctagagtatagtttaactccaatgcttcttgttgatttttctgcctggatgaccttcccgttgctgaaagtggggtgtgaagtcccctactattattgtattacagtctgtctctctctttagatatattaatatttgctttatatatatcggggtgctctggtactgggtgcatatatatttactattgttatatcaccttgctgaattgacctccttttgtagccctcataaggcttatgaaaaacattcagtagttataacaagttattaaaactgataccaacttacctttgattgtaaaaaaaagagacaaaaccatgtacatgttaactctcttctcctcccatattttgaatttttggtgtcacaatttatattttgatattgcctatctcctaactaattgttgtggttattattttattaattgtgtctttcattcttcttacaaaagatagaagtggtttacacaccataattacagtattagtatgacaatcacattagcatccttttcctttggtttgaagaactccctttagggcttcttgtaggacaggtgtggtagtgatgagtctcctcagcttttgtttgtctgagaaagctgccatctctccttcatttctgaatgatagctttgctgggtacactatttttagttgacaattgttttcctttagcactctgaatatatcatcccactccctcctggcctataaggtttctgctgagaagttgctgctaggtatattggatctccccaaaatgttgtttgcttcttttctcttgctgcttttgacatcatctctttgatctttgagagttttttgattatagtatgtcttattcttatttgggttgaatctgattggtgacctttgaccttcctgtacctgaatatttctatctttctccaggttggaaagtttgctgttacttatttgaataggtcttcttctgccttgtttttctcaattccctttttaactctgatagcttgaatatttgttcttttgatgttgtcccatagatcttgtaagctttcttcatttcttttcattttttttcttttttcttctctgtgtattttcaaatactctgtctttgagctcactgattcctccttctatttgatcagttctgctactaatgctctctctttcatttttgcatttcattcactgtatttttctgctctaagatttccatttgattttttctattacttcaatctgttaactttctctgataaatttgtaaattcagtctctgttttcttgaagttcattgagcttcctgaaaacagctattttgaatcctttgtctgagagatcacacatctccatcatcatgttagggcccgtctctcgcaccttattttatccatttcgtaaggtcacatttgcctgaatgttcttggtgcttgtggatgtatgataatgtctgaatcccaagagtcccacagagagacttttgactgtgcataggtacagaattcttgttgttgtgggaaatatgagcaggttaccttcaattccaccactcaataaactaaacatagcattaccatatgatccaccaatttcactcctaggtatatacttaaaagaattgaaaactggtgtgcaaatcaaaacaaacacgaatgttcatagcagcactattcacaatagtccaaaaaggtgaaaacaacccaaatgtccatcaacacatgaacggataaacaaaatgtgatatgtcatttgtggctgccaggagatgggaagtgattacttaaaggatgttcttctggggtgattacaaagtgttgaaactagagagggatgatggctgcacagcattgtaaatgtgctaaatgccactgaatcgtacactttaaaattcttaaaatgctgaatttcatgttatgtgtattttgcaacttaaaaaaaacatgtttacctaagtattgatagaggcaacattggcaaatgtgaatgtgtttagtacacatgcatcacattctacctgacatccttttttggagcaagaaagggtataaataaatacttcttttagagcttatatttaattgtattatttttatttatgcattttgttgggctataatatacactcagtaaatagagctcacacgtttagatatgtgcacagccacacagtcagtaccgagaccgaggcgcgggctcccccgctccagaatctcctctcatatcccgccccacctaaagcttagcactcttcagagttctagagtcaccctattcttacatctcagctcaacagaaccatgcagtatgtacttcatctgctgctctagtagggggttaaaggtgatgctattattctacctttcattttaattcatgaaatgaaataattttataagcggaatttactatttagtaacccatcagtgaagttcacacaggaaagtcaggataaatgcttgattattcccttttatttactgggttttcaaataatgacttggctacctatcatcctccattggtgaataatttggggcttttcagtaattttctgcaattattttttattgagatgtaattcacatatcatacaattcaccctttaagtgtaaacacagtggtttttagtatattcacagagctataaaaccatcaccactaactccagagaattttcatgacccgaaaaagaaaccccatacccattcccactcccatctcccctccctacagtccctggcatccattaatccaccttctatcactacagatttgcctgtcctgaacatctcacagaaatggaatcacacatgtggcctcctgcacctggcttccttgatgcagcctcatgttttctagatttttccatgctgtagtctcagggcttcactccttcctgcggctgattaatggagacttgtttatgtcatgcacacaccttcacatgcgtccactcacactcacaagtcatcaaagagctcaagcagcaggcaaggctcaggagaggcactctgagggacaggatgatgggcccggctgtttccaaaaccaggtggcttggggcgactcatccaacctctccaggcctcagtttccccatctgtaagctgagtggctgggcctcaggtgaccctgggtctctttccaactccacaattctgtgatttgagcaaataagtccaatcctgagttttgtctcactttctaatccagtaaaagttaagctattgtgtttacttgactcagcagagtgtgtgggggcagagcaattatgacataaaaccacgatcctctttggtactacaagctaatcaacgttaatttttcacacaacgactgggaaaatctgcctacaggaagatgccaccctgggtggcactggtgtgccgggagggggtgctctccaggtggccctggcggcatcggtgtgctgggaagggggtgctctctgggtggcctgggtggcatcggtgtgccggaaaaggggtgctctccaggtggccctggcggcatcggtgtgctgggaagggagtgcgcaggcccaccccggcgtgctgcctgggagtccacgttctcgaaaatgcagggtgaccctggcgcaggatcgggtctgagagctgctcaccgacccatgcctcctctagcaaatcgcctctctcacagtcacctcaacagcatctcagccgttgtccgacactgggtgattctgcacgcccggctcggaaccctgtgcattgcccatctgtgagccgacctcctgcctgaagccaccttctcatagcgctcagtactggggaccctggccgggaagtttgcacagagtatgagctctggctgaccatccatgtcctgggtacaactcaccctcctccgtgattcaaactgttccagcctggaataacccgattgctcctatgggaacaactgctcctttccagccaaatgacccatttcccaaacgccttccctttccattctctaaatactgtagcaccacactgactagcgtgcgggtctccaccacagttatgaccacccttccctcctcgtcccccaaagcactcaacagctctccagcacccaccgaatgaagcactgacccttcagccaggctctggagcccctacaagcaacgtccgtctgtgtccaggccgatctcgctgctccctcggacgtactcgccctacaccccagccaaacgcactccgtgtttgccaacatgtgcgcctttgaacatgcgttctctccgcctgcagtgccctcctctgtgtctcaatccttcccgtgcaccaggccactctgagtctgctcctccacgaggctcccagatcacccccaaagccaccacacctgtccctgagtgttcatggcgtcacagttgtcactgaggctgtggcacttccccttccaccaggcacagcagctatagttgtgtgcacacatcccctcctgaaccgagcagttctccgcagatatgggctgaccaaatgagcatctttagagctaactgggaactgtccaggggcgagaggcctgggtggtcttagtactgtcactcatctctgcttcagttaacttgagcaataaaataccctgcagataaggtcagacggcaggtgccagtgtgtcctgaaaagccgcaagtctacaagcagccggcaacctgcccggctatgctgtgtgcatccccacagggcgccaggagcaaacacccaaacacccatcctattcccgattcagggcaatggtccaaaagacgccatcgctgctacatgagacagaacgtcacagcgaagaggcaggcagcaaatagatgcctcagggcgtttctcaaagaaaggcatgatgcagcctgaaaaccccaccagaagtgtcttcctgaagcatctaaacgccctctgagttccttctcccagaagagagcagttacatgaagcagcaatcacagaacggaagtgcccggccacaaaggctgccgtccttctcctcgtcccagtccatcttacagaatggctcccctctgcagggccacacagttgcccgggatgcagacgctgagacgggagctgatgtgcaggtttctagggcaagaggcgggagagagtgggcagccgacaggacgggggacgcagcctatgcggagtggatgcctcaggaaggccctgcctgggtctcaaggccccaccatggggtcttgtctcattcgtgaccctgtgcacgccgtgcagcagtgcagacggccggggccccaccacagggggtccagggagaccaccagcgagagagtggatacccctgggaacaaagcgggcccagatggagacctcagacaaaggcagctctcagccctcagctgagcacgccgaggggctacagcccccatccaggcccaggccggctgccagcacagagaggcccaagtggaccccagggccaaaaccccaagtctgggggctgcaggggagcacggcacctggctaaagacacagcacacagggctacagcgggcagcctgtggtcaacagctcatcagcgacgagccaggcccagccaagacagcaggaaaaaaaatcaaacgggaggccatgccctctaccctgggggcagagctgagaggacagagaacaggcggacaaggcaacagggacccaggtgcgggtcagcaggcgctaaggatcccagggtctgcgtgcccagccaggcctcacaccagcgacatccaggggtctgcaccagagccatgggggaacagagacacgaacaggtgaaagttcagcagggctgcaggcgcccaggccagccctgaggcagagacgtgaacaggcgaaagtgcagcagggctgcagccctgagacctggtgggctggggtcaggacgttaagggtgtgtgtgtgtggaatggggctggccggccccctcccaacaagatgtaggaaaccccatggccgggatgaggggaggcaggaagggcaaggggcatggaggccggctgagagtccagaggagagaccagcccagacccagggaagaaggaaccccgtgggatgtcccagacagcaaggagagaggcagtggaaggcacaagggcgggagaaagacctcagaagggatttaaagaatgaagaaataaaagctctgaaatttattttaacagagctttgggctacactctaacctttgcttcagcagcacaagaaaaagaggctgcacagagtggccccgcaggccagaaggcagcaacgcccactgatgccggaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacccctccttttctcaaggtcagaacagcagtgaaggtcagagccagaagcacagcagacgctcccaagccacaggcagctgctgaggcctgagccggggacgaagctcctccctgcatggggacacgcggggctgcagccactcccaggcctccatcacacagggacggtacagaaatagcgtgtcttgtgggtgggtgctgggtcggggagggagggcgactgcctctccctttccaggcacatttggattccccggggtgtccgggaatgactcaggcctctggtcagcgcttctcagacctgtgttcacacagcgcgtctccctcctttccctccctgcctgggacctaagtacggctctgtttaaaactggcccaaatgcagggtcagcgcctgagatgcagcccccacagcagcccccccacagcccccccacagcccccccagcccccccacagccccccacagcagcccccccacagcccccacagcagcccccccacagcccccacagcagcccccccacagccccccacagcagcccccccacagccccccacagcagcccccccacagccccccacagcagcccccccacagccccccacagcagcccccccacagcccccccacagcagcccccccacagccccccacagcagcccccccacagccccccacagcagccccccgtagcccccaccccacagcccccccacagcccccctgcagccccccacagcccccacatgctccactcgatgctcacacgcacagttttatctccttaactctaatgctgtttaaaaactattgtcctaatcaagcaagaaaaactgcaggtttgcaaagcgtctgctctggaagagcggcaggccagggtggagagaccacactgccacacctgaacacagcaaggctttccaaactctgcgcaataggaagacgccgaatggtaaatggaggagctcgcaggagacgcagctctgactctgccccgccccggcccgcggtgctgagggcgcgccgatgtggatgcctctgtgccagcaccagcggctgcccctcggccccgaccctccccactgcgtcctggggcaccctcagagcttcggccatggggtgcacagcaccctccaagcattctgaaaggagattttagactcttgtgcgcaacacccaggagccgcccgcctgcaaagcacttggtcagcgtggcctggaaaggggaggaaggtcctggaggcagggctctgtcaggcggaggacgtgatgctcagagcagccagggacccccgtctgggcccagtccccctgcgctgcgccccacggctggctggaagtttgttctggaaaccacctccaagacaagtgcagcagccggccctagcagttgggaagaaggcggctgacgtggcttccatggaaaatgccagaaagcacatcccacaccaggacacctgggcaaacagcctcaactcggaaaatcccaggctggttcggtctctctgctgcccggacctgtttaaatgtccagccgtttgggaactgtgtacccttcgagaaacactccaaggccccagggacaccggaagccgtggagcccgggccccatgcgtctgtgttctcgccacctggagaggctgctagtgactgacaggtggactgcggggcctcaactgctactgagaatgccacacaattttaaaaactcagaaattgcttatttttagaattttccatttaacatttttggaccacggctgaccacatgtgactgaaaccgcaggtgagggggtgagcgtcagcctgtgtcaggctggacacacctgggggcctgaggagcagccgggggtgtagggacaggggctccccacacccacatggatggcctgtgcagtcaccagcaaggcgggttctgcaggcctgtgtcccggccaacggcagccaccaaacctctctgcacttctgttacagacaagtcagagaggcccagaaaaagggaccaaaattgaagaaccagggaatttcagagggaagggaagggaaaatccaactggcaagcagacccctgggccatgtgctaggaaggggttctgcccagcgaggtctacccccaaccaggacgggtaggcagtggccccagcaccccctgcacccccacggcccaccaggggactgcacctctacaggaaggacagaggcaggaggaacccctcagggctggagagttgccagccactgcccgtgctgggccccgccctgagacagtgtctaagcaccaccccatggacaatccgaacctggaggggcctgatcccggccctgacccatgccaggggccccagccggcactgcacgccggagatccgggctttccttggcaaacacgcttggctgtcctcgtttccaagtcagccctgttggtaaaacagtgaagccagcagtgaaatacacgaaacccgaacagccccggagttggaactggaagcttccagggaagacggcagtgtctaagtgtctcccttaactgctgtggctgcacccggggtcctgggggtgagaggcttgtgggccctgaagtcacctgctggattccaaagtgggccatgccaatgccgtctggaaaacatacggaaaatgtcattcccaggaaatgtggcacatcattcaccctggaccacggcacaaggaaatcaactcaccctggaccatggcataaagacagacggggccctctcatcagaaagtggggagcgggggtctcagtttccaaggaccccacaagcgacgtctacagggtgaaagaccccgtgcccagcaccgaaggacctgcccgacacacagtccccagccttgagcggagacccccagactgcatacaactgtgcaaatgcacttgacctccctttggttgtgagtcacaggactgtcttaaaaagagtgtcttcttccagtgccagaaaacagagagacgggggctgtgaagcacaggatccacagcgggcgggtggtaggcgggcagcaggtgggcggtaggcgggcagtgggcaggcagcgggctgagaagcagagcagagccccagccaggagcccagagggcggcagagcagcgggcaccgaaccagactgtcggacctgtgctgggggagagcgagagtgaaggaggaagagagacggagacagagagacggtgagagggagagggacagagagggagtgagagcgcttcccacaagaagaaccaagctcaggtcccaccctcccccagagcctggtgcagctgcgtgggacgggcaggaggtgcgaggggccctgtctctgacgttttgtgccagcactgccctctacacacaaactctcaggaaccatcacgaccccattttgcaggagaagatgctgaggcccagggcggtgagcaggccacatggccggtggcaggggcagaagtgggactgcagcccaccaggtggtgtcacagccaaggctgcggcgtcactgcctgtcctgcctcacctacccccagggcgacgctcccgactaaaccacctctgtcctatggtctccggggcttcctgacccctggggagggcggcaaagcctgtggaggctggagtcctgtgggctggggacgacgggaagaccaagtcgtctgtataatcgccgtgggcgcagccggcagtgccacccacccacccacaaggcaacacggggcctgagtccagccccaggcaggtgggctcccagagttggggtccctgaaccaaaccacccctgctgctcgctcacccctaagagtgaggctgcgatgctgtcagccaaggacactcacgtgggcagctccggtgcagccggccccagggggagaaatgcagctgtggctgtcgtggaggtggctgtggccaatggccgtgactgttgctgtgtctggcagagaagccaggtgcactggctctgtgcttcaaggagacctagagggtctcccccaagtccaccggaaatgtgtgcacattcgccctaccccactgtgtacctggcccaagtcgggagagatgcccaagagaccacagccagcctcagcacagtgaaggctgccctggcccttcggggtgtctgggaagagcctggcattctctctggggtagctctcacccttgcaaagcacagagaacaccaagagccccagacacacactacatccaaagggaaggtcgggcggctcccagacgggggacggggggacgggggacacagaaccaagccgccgaggagcacctgacaccggagcccgagtctcggctcagcaccaccacccccgatgcgtccacactgccacggccacagacacccacccccgatgcgtccatgctgccacagccacggacacccacccccgatgcgtccacactgccgccgaccacagacacccacccctgatgcgttcacactgcccccggccacagacacccacccctgatgacaccggagcccgagtctcggctcagcaccaccacccccgatgcgtccacactgccacggccacagacacccacccccgatgcgtccatgctgccacagccacggacacccacccccgatgcgtccacactgccgccgaccacagacacccacccctgatgcgttcacactgcccccggccacagacacccacccctgatgcgtccacactgccccggccacggacacccacccccgatgcgtccacgctgccacagccacggacacccacccccgatgcgtccacactgccgccggccacagacacccacccctgatgcgttcacactgcccccggccacagacacccacccccgatgcgtccatgctgccacggccacggacacccacccccgatgcgtccacgctgtcacggccacggacacccacccctgatgcgtccacactgccacggccacggacacccacccctgatgcgtccacactgccctggccacagacacccacccccgatgcgtccacgctgccacggccacggacacccacccctgatgcgtccacactgccacggccacggacacccacccctgatgcgtccacgctgtccccggccacggacacccacccccgatgcgtccacactgccgccggccacggacacccacccccgatgcgtccacactgccccagccacagacacccactggtgatgcggcctgagatgccaccacaccctggccagaggctcagtccacagcccataccccatgacctgtacccacaaaacctgcagctagcaagaaccggcctctgcctgaccctgtcatcaggggcgggaactccggtggcgggcacacccagcgcaattacagggcgagcatccgatgccctcctagtgggccggccacaaagcctctcatcagccaccccgtggagaaccacagccaaaagcctgaaccgcacaagatttggcgtctcaatggcaccttcagaataggagaaaatagcaaatcgaaactttggttttccgttccttatttacgactcaggacaagactgcctgagagagcagcagactccaagtgcaggctgcagtgcagtgtctgttctggagggggggctaccgcctccccagcccacacatgctcacccctccctccccacacacacgttcacaccctccccacacacgctacccactcccctccccacacacgttcgccccctcccctccccacacacgttcacctgagcattgcccacaccagcgtcagcagccctcacaggaagggtggcccccaggctctcggccccccgagcccagcttccatctcgggccataaacaccctttggccaattggcgcaccctcctccaacagactatgacctccccaagccccagaatccctggagatggagagcacgcctggcccccagtcagggcaggtagtctccagggccaagccgtcacctcagaagggtgggtggggctctccccaggaggagggcaggtccgggactgggaggacgacccccacgcaagcccccaccctgcccttgggctccagcctcatccccagcagccgccagccctctgagatgccagggtgccatggaccctgcactgaggggtgctcactgggcagccgtgtgaccagcaagcagaggcaggttcacagcagcagtggagctctccagaggcaactccaccaaggggtgccgcagagctctgtacccccaaatttatgaggagcccggctttgggaggggacacctaggggaaaagggctcaggaggcctcagccaaggaggagcagcactggcagcccccctcctccagcacggggacagggaccaccggcatcgaagctcctcacctgcctcctgcctgacaaggccacaggcacatccggggccagcactgaccagacgctccctccgcctcgcttcacccagcctgaggctggacgggaggcactggcgtctgcagcacatccacagcattccagaaacgacagaaaccaggccaggctctgagcagcccgtccgttgtcctgacacctgaccatgacggcatatttacggtgtcttctcaatctttgaaaaatatttttaagagaacatgagaacaaatcaatattccagtggcctaaggaagtcagctagctgtgaaactattacggtaagctacacagtgggggaatcagcgtgggggaaaggaagcgggcattccacagtgcaagactctgacacacagagcgtcttgcacccgccctgagctgagcagtcctgaccctaaagagctgccattcctctggggccacggcaggaaatcgcaggcactgagtgggaggaagaggatgaccgggtgttgggatgggtgcacatcgcagagcggcacacggcagcctccggatgggcgcatggcagagcggcacacggcctctgctgtcttttccgatgaactttcaataatacatagaaacatatgggtttaatgtttcctgtgtgtgtttacagatgtgtgtttaatattgaatatgtgtgcgcgcaccgtatctccacggagcaaaataagaatggagagaaactaacgcaaagaaagacgctaacgtgccaggctttcagtggggacaacttctcattcttgaaaacttaaaattagcttttccaaaacatctataaagcaacagaaatgcttacaaatttaacagcatttgagattattgtaaataaaaatgataggtctaatttttcttttgccaacatttccttcgtttatattgacagtcaactcattacgtgtaacaataatggcaatttttcctaatgaagtttaaacataaaatataaaacaatgtaattcggagctttgtaaataaatgcccattttacttagcgtaggtgtagaaattcacacccaagtcccacttagaacacgcttcccgctccggagcataagcccctggcgtggggaggggttgggctctgtctgaactgatcaccaccactgctttattaattgtttttggcttaacacctgaaccagctgggtgcaaactatgacacacattacaaaaccacctgtccatcctccaggcacatggaaggcacacggcccacagaaaccaaactatatgctgcgtcccatttagaaagctctgcgtatgtttaaaattaaaagtcttataaggaaactatttttctgtattttaaaatgttcttaattacaaagaaatagatattcattctagccagttaagtctccaggtagaaaaagttaactcttttccctccctcagccaggcccccccagagccacatctggcaaggacggcttggtgtgcacgcccacacctcctctctcgtgcacggccacatctggatcagatgtgcaggcatttcaacatggcagtctccatccagccacggtctgcggacagcgttcaggctccagccttgaccctgggcaccttgaccctcacggggtacgtggcctgtgtgtctgcctttgtgtcctggtcctcgcaggggacaggcctgtgtgtcccacgttcgtgtcctggtcttcgcaggggatgtggcctgtgtgtccctccttcgtatcctgacccttgcgggggacgggcctgtgtgtccctccttcgtgtcctgaccctcgcgggggacgggcctgtgtgtcctgccttcgtgcaccctgacaccatgggtctgattttcccacgctggaggtctgcttctgaacagctgcatctcctcctgcaggggaagctgtctgttcacccaggtgcctgtcctgtctgagggctgggctcttcctacccaagggttgggggctggcctgtccctcatgacccaggcaggcggccagggctccccggaactccaggctgctgcgggtgtctgctctgccctgggtgaggctctagaagattcctgtggaagcgactgtgtctaggggagcccattccccagtttaaaggacgtccccccccatggctatccacatgcccagtcctctcaggaagttccaggctgccaggatcagaggaagcagaagccgctgtccttcagcaggaccctgcaaaagcaggatgaatcagcggggccattcagaacaaggttcaaattactgctgcacttttcagaatggagccaggctcagtgtttcagaaccagaggctgacgcggatcagctcgcacccagcctgggacctgagccagcccctgagtgccactctccacggccgcctcagagggtaagcctctccaagcctgcttcctcgccggcatggtgggggtggccctgccatcccctaggggctctgcgggatcccctgaacactacgaaaaacctgagccccactcctggccactgggtaaggacctctccgagcctttctccttcccattcactcccacccccaggcaggagcgaccagtgctgagaagtcctatcatcccacaacccatcatcctccgtcatcccctgtccgtcaccccgcagctgtcatcccccatcaccccgtgtctgtcaccccgcgtctgtcaccccatgtctgtcaccctgcatccgtcaccccgtgtctgtcatccccgtccgtcaccccatgtctgtcaccctgaaaccatcaccccatctgtcaccccacatccgtcatcccgtgtccatcaccccgcgtccatcacccccatccgtcaccccatgtccgtcaccccatccatcaccccgcgtccatcatcccccatccatcaccccccgtccgtcatcctccgtccatcaccccacgtccatgatcccccgtccgtcaccccgcatccatcaccccatgtccatcaccccacgtccatcaccccatgtccattatcccctgtctgtcaccccgcgtccgccatccacatcccatcaccaggtgctgttttcttggtgctagagcaaggtgggattcacaccttgtgtgcacagcttctgagtcactgggcggctgggcacagcctaactcaggagcagggacccacggagggtgtggcgacgacacagccctcagcttgctctccaggagttcttctgatacctcgaggacactctggaccctgtgtctgggtcccagcccttccgtaacaacgtggctcctctgaatcagtcacaaggaagatccaacttaacacagagagtttttcccaaacagcagaactggcagcaacacaggcatcctgcagttcagtccactgcatgcagcgtgcaggtgtcggagggcgaggctgccgtgggctcccggcggacggtggcagggcaggcccaggtctctatcacagcaaggcctctccactcggccccctccacctgtttacaacctcaagctgggtcaaaaccccaggggtactcagagggagtgtttctccccaactggattccttaagccagagggcaggcggcagggtcctggcctgacaaacacacacgggcccccgaacacgaccggctccgtgaccgtcacaggacgttcaggtggcttcattttcagtccacgcctctggtgccagggtcttgcttggcacttgtgtgaacggcgaccacgtgaagcctctgtcttgagaaaagtgtaaacagcagctgcctttcaaggcactgaggccttcctcgaactcagctcgtttgtgctgcgtggttcccagtccaaaccctcctgttcacagcctcctcttgcctcaagcatcttagagctccactccaatccacaccccagctgccttttacaaaatcccaagccaatgacagcttgaaaataaagtgagaaaaacaccgaccaacatttactcagcacctacggtgggctgcggacgttgacacagggtcctctctaatcttccatacagatcagccatgagggccgcggagaggagaaaagcacagctgagctgttttctcttaaagcaacataaacgtcaaagcaaaactggagcccaggactctctgacttaagctcatcctccttctgctccatcccggctgtgcacacctggagaccaggccctcgagcctccaaacgccgtgagcagcctcctcctgctgtggcttccaaagagacgtcaccagaggcggggctggcgcagggccacgaggcaggcgactgggtctctttgaccgggggtggcctcgcggcggcacgagactcagcatcgtgtgggtctagctctgggaatcgaggcagcccccagaacacccttggggcgcaacttcccggtgaacgtcccgtctcctcagccacccacagatgctgccacagctgcaccctcagggcaacgagcgtctggcggagcccagtgagagccgtgaaacacagacctcagggccaggccctctccccatcacagaaacctgaccagtcacaggtggctgcagcctgggtggttggtaaaagaaaaattattccttctataaccagaaaaaaatagtgaatcaacagacacagaaatgctcagaataaaacaaaaaatctaagtcagtgggacagaattcagcagtccccaggggggcctggaagctggacccctgctctgggtctacgggcttacatggctgccaggaccagggagagacagacccgggcccctgaccataccctgtgctgtaacgcctgcaaggtagattttaagtaatttaaaaattatcaaaaggataacatttcatgcctgtgaacattacgtgcaactcaaatctcagtgtctgaaataaggtgaaatggatacagtccggctcactggacggcaccgtgcctgcggctgcttccctgcacagctgcatgacccctggccctacacaggacaggttctgcgcactcggccgccaccttccttacacggcttctcaggaaagcagcaggcagctgtggcccagcgtgagccggcaaagcacttccctcccagagccccgtttcctcatcagcaacaaacacaacaagcttcctcccctggctgctgtgaggaccgacagcccctcctggcacctgcacagggcatgacacgcacatcacagccgccttcacccgctcagcctcccgcgtccccacagcccggaccggagcctcagagcaccaggacacacccatccggacaccggcaggtttgacaccacagactgtgcttggctggggagtgagaatcctcctgagagagccacggtgtcccaggtcgggggcagcagagtgagggtctggccgtgggccccggtcgggggctgagccacgctctggtcaggaaagacatcgccagacacctgtcataatccagggctgctcaaagtaaaaaaaaaaaaaacctaaaactgcaacatggaacggcacaaacgagctgcaggccgagttctaacgggctgagcctcaaaccagctgcaggccgagttctaacgggctgagccacaaagagctgcaggccgagttctaacgggctgagcctcaaaccagctgcaggccgagttctaacgggctgagccacaaacgagctgcaggccgagttctaacgggctgagcctcaaaccagctgcaggccgagttctaacgggctgagccacaaacgagctgcaggcggagttctaaggagctgagcctcaaaccagctgcagaccgagttctaacgggctgagccacaaacgagctgcaggccgagttctaacgggctgagcctcaaaccagctgcaggccgagttctaacgggctgagccacaaacgagctgcaggcggagttctaaggagctgagcctcaaaccagctgcagaccgagttctaacgggctgagcctcaaacgagctgcaggccgagttctaacgggctgagcctcaaacgagctgcaggccgagttctaacgggctgagcctcaaacgagctgcaggccgagttctaacgggctgagcctcaaacgagctgcaggccgagttctaacgggctgagcctctaaggagggaaacgtcacttcctgcctcacacagagcccagcgtctccatgtccactgatagccttggtatttgcaactatgtccatgaccatctctgtttctccaaaacagcctctagctacataaactgtttagaaaacctcatgcgtaaagcagagtatgtcaaacctccatctgtggtcaggagttaggacatccccagctgcaatttgagcaaagacggcgcttccagaggatcatcggatcctgtgtcttggttggggttggggcccatcaacttaaaatagcttctgtttatgctggtgaaggaggcacagacttcaccctatctaattccaaggaacaggcgagggtgggagctgtagcggaagagacaaaagcaaaaggcagattcgcccctttgtgtggtcccgtaagtgacactgtccctccctctccctggaaacagcagcccccaggcaccccccccagcaactgggacaagggcacaccaggctaatttttaatcagatggatttagtgatagcaaataaagagaaggagaacaaaaccctcagccaggctattgtgaatgggtgttaccaaaaaatggcattagcagggcaccaggggccaggccagctccaggcagccccgcatctgctcagcaatccccggagtcttctagggggcctggggcagccggaacctggccgggtggaggatttctaccacgagaaagtcagggccctccccgaaggagcagaagctctgcgggtgactgtttgggaagctggtctgctcctgatactctgcaggaagagaatcacactctttagaccggggtctcagatttcagccggacgggaactctctgcagggccggtggaaagagatcgccagccccagctctgtaggggtgcggcctgcctcgagcacttcacacgcgtgcccggggatgctggtgctgcaggtatggggaccccgctaggagagccccgggttaagggttggtaactggagaatggggtgggggtatgccagctctccctgcttgccctggtcccacacactcaggcctgtgtggccagcgtggtcctcctttcccacagccaaggtgccccgactgccagcgtccactccccgtggggccgcagggtacaccaacatctgaggcagaggcaccgctgtgggctcatctctcagctcaaagggtttccaagagaatcctcagcaaaaaagcaacactcgccgttcagagagtgaatgagaggccagcagggggctgggaaggtgcttagctcagggagggctggagggtgggactaggaggcactaaaggcctgggggctcagagaaaggcccagcccatcccagcagaggccgaccaggactccagagcccgtggaggccctgccatgcacgggaagcctttcccgacttgggggcaggagctggagggctgggatgatcctaaggggatgctcggccataagccacatgccaagtccagagcccaacagctgctgtacctcctgggctgtttccacggatgaggcttctctgaatgtaagtttgtctgctcagccacaccggcctcctcctggcacatcgtctctcacaggcacctccttccatggagactgggggcctcagacggctcttcccgacagggccctgcacttgggcagatgcacctgtggcttgagctcagcacagcacatagtggctggcaaggaacggaaggagaattggagaaatgtatctaaaatgtcaagcagacctctgctacactcactgggaagaaccatgttgcttctgacgaatttcttaaaaagagagaaagatgccaatgagaaaaccagaggggacaaatgctacccgggaatgtaaaacagttgccatcagagactggctggctcacattgtgtccaccaatccacccaccacggcgagtgatgtccgtacagctcacaccgcatccatcaatccacccaccacggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtatagctcacaccgcatccatcaatccacccaccacagcaagtgtctgcgatgtctgtagtgtctgcgatgtctgtagtatctgcaatgtccatgcagctctcaccatgtccatcaatccaccccaccacggtgagcgtctgcgatgtccgtgcaggggagagagacctggcctatcctcagcacagcccatgtgacgttagaaaggcaaccgcaaattcagctgcggagtgcaaaacgaatttcctcctgtcacacgctaactttctgttctggatttcctggggtttcctttattagacttgagtccagaactcctctagaaacattctctgggatatcttgacctggcacgcagaggggtgaaggaacggggacacggatggatggagggagatgaactaatcagcaaatgctccttgcacatttcctagctctgtcagccaaagtgaggtctgaccacaaaagctacccattcacttgctaaatggtgcaaaatgggcccagaccctcattttacctttacttaaataacagcatattctcgtctggtctttaaaccacacaggccaaaatgagttgagcactatcacatatttaattgactcgtaaaagcaacttgtttttcttcatccttcgccgacctttgtttatgggtaacccttgataacatgtgggcagggtttcagtgtaaacccgagggcaggttaaacacgctccctccaaagcttacttggctttgatttttcaaccacccgccctcatgtgcagggacagggcagagtcgtgaccaacagtggaaagacccatagctcccagctccagggacgacgcgggggtgctaagctggtaagctgggaaattcccgggcacgacccctggccgtgggtgaaagcacccccagccccacccccagctgtgagatgctgcaggttccccagccccacccccagctgtgagatgctgcaggttccccagccccacccccagctgtgagatgctgcaggttccccagccccacccccagctgtgagatgctgcaggtcccggcaggagaaggcttctccacagagaggccgctgaacaaggcacagggccaggtctggccgtgtaaaaatacttggaacccatggggggctttgtgtgtggtgtcatcggcagcttccattatgtccagcggtaacatgtttacggtccctgtgccgccgtgcggtagcagttttcccgagtgtctcctggctgggacggctggtgaggatgtgagttcaatagatgaacaccccaccttggtgacacagaggctggacagtcacaccgacccttggcccgggcgaggccacgtgtcccacaaaacataaggcttgggttagtgtcgggcacgcgggggaggtgcctgcctgcgtgaagactggtcacaagacaacttcccagtttagaaaatggttaactgattcattaatactcacttcctgtcgcaagagactcatgccctagagataaagccgtcggaggcagagtgcaggcctcgaagcagctggtcatgtccacgccctctgcaggcctcgtgtccccctcgctgtcgcctgccgatttggtggctcctctcataacacacagcctcctgtgtatgtttttaccctacaaacgctctctaaccggtccagaggtcagaaacagccgcagtctcctacctctattgcttctcaagggaaaagcacagcctggaatgatgaggagcccccacgccttctcagtctcctgtaacgacgttgctacagatgtatgtgtttgtgtgaagctgtatttaaatgtgagattattcttcttggttaatattttactttctgtcataaccagcaggcttaaagaagaaacccaaacgctctgtgaatgggacatgtgctcagaggcgtctgcagttgaggcgggtgacgttctggggtccctgggaagttgtcatcaccctgctgacatgagtgtggatgttgaggcctggagggtgacaggtcacacagccagagcctggcagcagcgcaggggcggaaccccgggtcccctgtgggcctgtgccctctcggccagccttgcaacgcgcagctaacgctcttcaagaaaacattctctggaggaatcctgctggtcctgaagtttttggccttgagaaggtcatcacagacacccctcccctcgggccaggcctgctgtcttgtctaaggggccctattttatctgaggtgatttgcaactctgaaacacacatacataaaatagaaataccgtcctcactattaacctagagacccccatccctacccctccctatgaatgctttttcataaacatgccgcattctgaggaatccgaaagactccagcgtaggacagaccgctgttccaagccactgggaaaggggaaactggtgactgagcggcgcccgtcagagccattaaaacgtgagggaaaactgcaccttacggcacacgaacccttagaagaggcaaaacactactgagttaatgcttaatttatttgtaatgataaaagtttttatcactttaaataaagttatttgaaaaaagttattcaatggcagcctaataattttgcttaatgaaaaattaactctgcaaatacagtttccactattcacatggagcctgcaggtttggagaatcctctgcatcagtgtgggtgagcacgtgtgtgaggggtgcacgtgtgtgaggggtgcacgtgtgtgaagggtgcacgtgtgtgaggggtgcatgtgtgtgaagagagcacgtgtgtgaggggtgcatcagtgtgggtgtgcacgtgtgtgaggggtgcacatgtatgaggggtgcacgtgtgtgaggggtgcacgtgtgtgaggggtgagcacgtgtgtgaggggagcacgtgtgtgaggggtgcacgtgtgtgaggggagcacgtgtgtgagggatgcacatgtgtgaggggtgcacgtgtgtgaggggtgcacgtgtgagaggggtgcacgtgtgtgaggggtgcatgtgtgtgggggtgcacgtgtgtgagggatgcatgtgtgtgaggagagcacgtgtgtgagggatgcatgtgtgtgaggagagcacgtgtgtgaggggtgcacgtgtgtgacagatgcatgtgtgtgaggagagcacgtgtgtgaggggtgcacgtgtgtgaggggtgcatgtgtgtgaggggtgcacgtgtgtgagggatgcacgtgtgtgaggggtgcatgtgtgtgaggagagcacgtgtgtgaggggtgcacgtgtgtgacagatgcatgtgtgtgaggagagcacgtgtgtgaggggtgcacgtgtgtgaggggagcacgtgtgtgaggggagcacgtctgtgaggggtgcatgcaatgctcctgtatgcacatctgtgggtgagcacgtgcgtgaggggtgcacatctgtgggtgagcacgtgcgtgaggggtgcacatctgtgggtgagcatgtgcgtgaggggtgcacatgtgtgaggggagcacgtgtgtgaggggtgcatgcaatgcttctgtatgcacatctgtgggtgagcacgtgtgtgaggggtgcacgtgtctgaggggtgcatgtgtgtgaggggtgcacgtgtgtgagggatgcacgtgtgtgaggggtgcatgtgtgtgaggggtgcacgtgtgtgagggatgcatgtgtgtgaggagagcacgtgtgtgagggatgcacgtgtgtgagagcacgtgtgtgaggagagcacgtgtgtgaggggtgcatgtgtgtgaggggtgcacgtgtgtgaggggtgcatgcaatgctcctgtatgcacatctgtgggtgagcacgtgtgtgaggggtgcacgtgtgtgaggggtgcatgcacacacacctgtaagcatgtgtgtgaggggtgcacgtgtgaggggtgcatgcacacgcacctgtgtgcacatgtggatgttgccgtgtgcacgtgtgcacaccaagtgtccgtgagtgcacgggaacagccgtttagaagtgccttaatcttcccgagcacaatagtagctcacctctgcaaggaggctgaaaattctcattatgagtctcataaatacgtggccacgttcatgggtttgtcttatttatcccttactctataataacttggaaggcacagccaatatttcccttatatcctgggacagccccagttcatggctcccgacgactgcagctgcctcctgggaaccccaggggggcaaactcaggcccacccccgcctgtgtgactcaaaccccccagccaagtgcctgtgggaggacattttagtgggtggggaagcttctgaaaaatcactttactctaactaatatttgtaattaacacatcaagtaaaactaaaagcttttgccttgccgttgttgccttttggtgggtgacctcaaaaagtcatccatctcacactgactctatcacatcccaactctagccccaaatcctaataaacacaccagttaagaatgcatggcacatttttacaagcctcacaactttctgattagatgcatagaaatgtcccaaatatttctgaaatattttatttgaaaaccgatgtcaccgccacttttaagccacaggcattacactaaaatctggactagcgtctaagcaagtggcagcttttgagctccgcacactccgtgtgaccatccacaaatctatgatgaattattaaccagaccaggctagcccactgcctggccttctctgctgaaagtcagcagctgtatcctgcctgaaaaacaccagcattcttgtgttcataaaacccgctggttccagtgcagctacccagagggaagccttgggtgtgggcagcgacaggggtgtgggtgccaccgtggggtcccccagaaggaaaccaggggagcacagaactaaatggtcacccatgacaatgaatcgtgatctggtgggaagaaatcaaagtgcttttatttggagatgaaattggctgcctgcccctccctctccaccccccgctttcctcctgacccacccaccccagctcttttccccggcctgggaagggcacatggagggcagaaagggcttccctaaagaaaacacagaaatacactttataaagcaaaataaacttaaaaaaaggcacttagcaaaaatgtagtgagaagtgttttttcctttccagtctttcattttcactcagcatttccataaacacattcttgggtccaaatgctgagaaactctttctctaaatactggaggagcgctaaatggagcaggaaatgatggagagagaaaggaatgccactgattccagacggatgggaccagctggggaattcaggaagcggtacggaggtcccggagacaactgctcacgcctctgaggggccgatcgctcaggatcccccagcagcagcgagagaaccagcagggcccccctcccctctccagccaggcgtcgatcagtgcccccctcccctctccagccaggcgtcgatcagggcccctccctctctccagccaggtgtcgatcaagtcctcaccttctctccagccaggcgtcgatcagggcccctccctctctccagccaggcgtcgatcaagtcccccccttctctccagccaggcgtcgatcagggccccccctccctctctccagccaggcgtcgatcagggccccccctccctctctccagccaggcgtcgatcagcgcccccctcccctctccagccaggcgtcgatcagggcccctccctctctccagccaggcgtcgatcaagtcccccccttctctccagccaggcgtcgatcagggcccctccctctctccagccaggcgtcgatcagggcccccctcccctctccagccaggcgtcgatcagggccctccctcctctctccagccaggcgtccatcagggcccctccctctctccagccaggcgtcgatcagggccccccctcctctctccagccagacgtcggtcagggcccctccctctctccagccaggcgtcgatcagggcccctccctctctccagccaggcgtcgatcagggcccccctcccctctccagccaggcgtcgatcagggcccccctcccctctccagccaggcgtcgatcagggccctccctcctctctccagccaggcgtcgatcagggcccctccctctctccagccaggcgtcgatcagggccccccctcctctctccagccagacgtcggtcagggcccctccctctctccagccaggcgtcgatcagggccctccctcctctctccagccagccaggcgtcgatcagggcccccctcccctctccagccaggcgtcgatcagggcccccctcccctctccagccaggcgtcgatcagggccctccctcctctctccagccaggcgtcgatcagggcccctccctctctccagccaggcgtcgatcagggccccccctcctctctccagccagacgtcggtcagggcccctccctctctccagccaggcgtcgatcagggccctccctcctctctccagccagacgtcggtcagggcccctccctctctccagccaggcatcaatgccgttcaaggggtctggaccaacaagccctggtggagaacaatccccacagagaaactccgtgtgaccctgccccacagataacacggaaagggacttttcatggtcagaacctactgatctagaagtgatcaaacactctcttctcctgacttcctgtcaccaggcacgggtgaggaggaacaccagcaatttcttactaattacggctcaagcaccaatgtttgtccaccgttttcttctcacacagatctaagaggatcaagatgattcccagagtaacatctgtctcatttgaattccagtgtgcttccccgagtggcacagccgagctagtcttgggctctggaacagtccaaagactggggactcccctgtaacatgcagccacctaagagaacaggtcagtgacaagtagggggaaaagctattaggaaaaagaacaagttgtgggcctaaaaacaagatgtttcttatacaaatacaaaatactagaaaattgcacagcagttgccagaaaagatcccaagttgtggaaagtagaaaggcaggtgcatcccagcactgcggccgggggcaggaggccacccgcggggcattcggacccccgtgccccaaacacatcccgccgagcctcctgggaccaggcccctgagagccacggggctgtctggagagtgtccccagcctcagccatgtggggtagaataaaaatgattaagaactgcttgagaagttttaaactgcatgcagcctactcagcacagattggcccgtgtcttctgccacggatctcggctaaaggaaaagccaacagaagcccaccggagcctcccttacctccacccaacactgcacatcaagccgtgcaaccctgccccaaacggtcccagggtcatgggtgtgcatacatgtgcatgtgtgcaagcatgtcacaagaggagacctccgaggaacataaggatgcggactcctccctcagcctgaacctctgtctctcaggcacagctcgacctttgaccttcggcttccccagagaaagactttgaacgcttcactcctctgtagccctgaggacgcgggcggccagaccagtccctgagtgcggcaccatggccgtgtgagtttatggcccattgcgctagccctgtacagtgaatgagatactagttgtttacagctgtgagcatacacaggccccccgccacacgctcaggaaggagcttctcggaatctctctcctgcctcgcaccatgcagccgggctagcaggtttgtgggccgagtgcaggagcctgctcccactgtcactgcaggtgactggctgaggggcacacagggcccagaggctcctacctccagccaccgcccctaaactaatgaagattccagtccgtggggcccaccgcaaatcccagaatctcagcagtcagtcttggacattagttgtcggggagggagaggatctgggaggccaggcgtcccttccaggctgcgcagccggccacggcggcagagcttccccaggctgctccagccttcagggcccctccgcggtcagccccacccccggccagcaaggcttcctgagaaggctgagcttggcacctacagactgggggggatctggaattccccagaaaagccctcatcccaaagcccatgggaaaaccagccctgttggagcatcccacccggacctcggaggagagtccggcatggccagtcccctgggctctgcatgcagatggttttcccagaaccggttcctcttcctgaatctctgctaatggccctgtccatcagtctgaccccagccttggaaacccccatgcagcctgggccagaatgaagtaggcaaccagaggctcagggtgcttggggccgaaccacccccagctccaccacctccttcctgcccccgagccgtgccttcccccgctgggtgggcttgctctgcatctgggagcacctgggcccgggggtgcaggtgggttcgcccctgcccattggagggaaatgttctgacatggaagcagagggcacagcattcaggagaaccagtggggcctccacacagggggacgcagctaggaagggggtctccggccggtcggccccgagtgagggacgcagctaggaagggggtctccggcaggtcggccccagccctgactccaggcctgtgcatctcactgctgcccaaagcaaggaccactggctgccatgacagctgccacagtgctgagcaggcccagccaacgctgcatgagaaagggctctaggaaggaaaaggccgcggcagcacccagcctcctttctgaggaagcgattccacgagccacaaaagcgcctgggctgtggtcatcagagtccaccacaagacaaccttcctgggtccctacaccctggacacaccttcggtgcgtgcccggcatggagacgctcctgctgccggcatggctttggggacagcactttgctcctggagcctcagaggaggggggccggaaacatgtgtcctgcacagtcaccaccggacgccgaggtggccgccccagcaggggccatgggctgaggctggtcctcaggctcccagagcaatggctgctctggggaagagaaaacacagaagtgacaagatcaaggcaaactagctgctccagcacctcgagggtttggaaccaaaacaagaaatctccagagctgaaaagaagagtgaaaccttttccttcagaaggaacacagctaaagagaagatttaggggtgcacgcaagggccctcaggtactctgtgcagcccctcaaagcagggaaaaggccaggaatgaaacctaacgcagaaatgggaactggctccaacgccacacgaacagccagcctgggtctatcgcgcccagttcagacccgggctgcagcttggagacgatgacgtccaaaaaccaagctccaggaagacacaacaacaatcacccttaggctttgtcaggcatcccagagaatcctccgtcctaccctgggcacgccatgcgcaccaggcagggagggtggctctcagcaaggggctgaggactctggcccatcctggggcgagggaggcacccacggggtgggccatgcggggctgggagccacggcccccatgcaggtcctaagtggacatctgtctggtcggtggtcagaaaaaggatccccacggtgtctaggaaagactcagacctcttaccaacctctggaattttatcctatgggcagtcagggccaagacagatgattctttacaggttggaaattattcggataacataaaagaaacaatgtaaagaggaaagaacaggtgcaggagtcgttcctcgatcaattccaggtcaaggcaccggtttcggtccccagtgcggctcctgtctcctgacccagccccccggcccagcccccagaagcccggcacggtgtctctcgggacccaggacacgcaggtcagcgctgcagccgttactggctgtgttgtgataccagcagggcactgactgtccccagaaggaacaaaactgagacttaaatttgggtgattgttccaaatgtgggattcaagcttatttgaaaacgaaaactaagaatgccaaatttcagggtggctagagctacagccccaggaatccagccctgtctgcagaaacacacctaatattttcagacactcatagaacaaggaactactatttttgagaaaatactcacagaaaaacaaaatctcccagacactctgatgccgtttgaccaataacccatggggaaactcacttccggggatccaggcccgacgagggcgttcccgggcacctcggtgactctgaaactcatatctacagcaaagcttgaacgtttgtaactgttcactttggactctgcgtcacacccagagagaccctgaaccatctgtcacaggtgacgtaaccctcagttccccttcacctgtgccagagcctcccagacacaaaggctggagccccaaaacctgtcaggggcctctcaggggccagccacaactcactccgcctgtcactgctggacgcccgctgcggcctgacggagccgctccttcacctgtccacatgcatttcccacacagcacattgtcttgaatgaaggcaagttattttctttctcggccttggcgtcctccacagccgacactgttcttgcaatctgtgaagggatgatttctaagctccgcctttgttcttcactcactcacccaccgtatacatagttgcacattgatgcataatagacatatacttgctgctacggaaggccttgtattcctgtctctcttcctaccacagcactcctgccatcccacaggtaatccaattagcaggctgtgtgggtcttatccctgatctgcgcacactcatctgatctgtgtttatcattcttctagggggtggtgttgggcgctctcattttgcttcttttgaatcttatgccgtggaacttcctgcgagtcatgtggtttggcctgggcttaatatgttccttgaaagccacagagcagcccacatgtggatgcacatgacataatcaccgtttcagttggcgattactcattgggctgttcttgcattgctataaagaaacacctgagactgggtaattcaaaataaacgaggtttattggtcacggtgctgcaagccgtacaggaagtatggaggcatctgcttctggggaggcctcgggaagcttccagtcatggcagaaggtgaagggggagcaggtgtctcacacggcgagagcgggggcaagagcgcgaggtgggaggtgtgccaccggatctcacgagaactcactcactatcgtgagaacagcaccaaggggatagcgctgagctgttcatataaatccaccctcaagatccagtcgcttcccaccaggccccacttccaacgacggggtgacagttcgacaggagattggtggggagaccccaactcctcaacattgcttctactgtttgctatttgctcactcagccactggccacaggtgctgctgcagtagacacgtctgttcatcgccttcacctatggttcaaagctagaagctctggttgcacggcaagcccctcctttcctgcgtgaacacagacccctgctctgacccgcggctgcgtaagacgagacgcgctcagtgagctgcctccccgacccccaccacagttccacaacggctgtccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgtccaacctcgcaccctccagaggtaccggcacctgctgtccaacctcgcaccctccagaggtaccggcacctgctgtccaacctcgcaccctccagaggtaccggcacctgctgtccaacctcgcaccctccagaggtaccggcacctgcggggcatgacaccacatccccacgggaccccgtgtggccccttctgtcaacccatcggccagaggcccatccacacgtcccactggcccctccagctaacttatctgggcccctcaaaggccaggccgtgcatctcataacaccagcccaacccaaatgattccttcccttcctgagacctcactctctcttcaggggcaagttcaaagctacccctcccagaccccctccaagatgacagccaaaaccaaagccacctctctcttcaggagcaagttgaaagccatccctcccagacacccagatgacagccaaaaccaaaaacaaaagccacctctccagagtgtgagctctcccggatctcaacaccctcctacttattaaagtgtagctctttttcaaattatatatttgcttacatagaagtccagttcattacagacgaacagatagcttcaaattctgctagaataatacctcccatctatgaagatctgagcgggggaagtgcctggtgcatctaagtcccattaatctctgcaaaagaaggccttggcctccactttcacaaaccaagaaaccaaggcagagagaggttaggggtcatctaaaatcaaagaattgtcaagaaacgtggccagcacgcagtctcgggtgtctgattccaagtgggttcgctacgtccacgtctcccccgagggcccccaggagctctcctcctcaccaagcccctcccaccatcgctcagcagccttcactttcaaaaccttagcagccatcactttgcttgtggctgtttccagccaatacgtccacctcctttctaaacacacacacgtctatgtttaaaacatgacgcgccacctgcaaacacggtgccacagcctcagggagacgccgctcatccactctgcgcctgcgcggttcacacgctccttagctccaaatgcctcatttgcttccattagctccaaagaagcaagtcaaagtgttttccaccaatgccagattcccttccaggaatgacgcccccagggctgcctccggggtccacactctgcccaccagtccagcaccctggctgagtccacctgccaggcaccatttgctcacacacctgaaggctggatgggtggctgtggccctgcttaaaggatcacctctgcatctccaaactgtcttcccagcacaccctgtgtcttgggcctcccaggccactgtccacccacacagaccagcagccccttccttccttccctgcctgaacactgcctgcctcgtgtccctaaggtcaccaacaagtctctctgttctccagccctccatgattccccccattccaatccaagatcacagagaagaaacagctctccaaactgacaggcaggctgcagtggtgagcacctgtgtcccagctactcaggaagttgaagcaggaagatcccttgagtcctggagttggagagttggagaccagcctgggcaacacagtgaggcccagtctcaaagaaaaaaaaattaatggacaatactaagtggtgaggagaagaactcggatcccaggagcccgtggagctggggtgcttgggcccagataaatccgtgggtctccctttctccacctcagtgccgtggagtttccagagtttagataaaatgagataatacatggaaacgacgcccttagcatctgcatccagcctccacacccacacacgcacaagaaacccactcccctttccaggcaaggcccgggccccaggctgaacctgcccctgccggagcccctgctgtttcccaggtgcagccaggccctgcaccttcgtcctcaggggttaaaaatagcacaggcagcttagctgagctcggttaataaaatatccaagttaattttagcattaggggaatctaggatctctgatgccaaggcccatgtgtggccacacagcccctccttacactgtcagacagacacggggaaagccacggcgtggccagtatccctccctcaccttcacaaaacacttctcttacctgagtgagccctagccctctgaagacactgttgctactttctcttattaaacagaccatcacctaatttgatgcctgtaacagccctgtgaccagcggcctccacctcccgtgagggagtccatcaggctgagagtgtcagctgccacttctagcagagctgggcccggagcccttaccttctagcccaggagctggggccagggaggcacagtccaggggaccctccaggcaccccacttgtcattctccctattctcacccggtgccacctcctcctgcttcaggtgggattctgtttgtgatcaggagagggatagctggggctggaggccggcagcccctggccctcactgccccacaggcctgcaggcaccagcggttcaatgttgggccagaccggccgtgggtcttcttcacggacaagctccagcctcacaggaagggagcaagagcccagcggagccacaggcactgagcccagaggagaaagaagggagcgaccagagagccacaggaagccccagcggggagcccacggcaggcccggcctcccacggacggcattcccggacgctgaccgcctccagctcgacggcagggtcaccgcggtgcgagagcctttcccgccctggaccgcggggctggctttttttttttctgtaacagattgagagaaacaccttgtgtgttgctctttattgaacacatgtatcaagataaggcgccacatttaaaaacaagcagtaagtattgtggaaacggaagacatcactgcgaggggaggaggcactgcacgccttgggggcgggggccccaaaacaacgccgtggccgtggcggaagtgccctccctgtgggtccctgactcatggaaagtccgaagcacaggcttcctcaaagcagcgatcgcataggaagtgtggctcagtcatgcatgatacacagactctactgtgaaaggttaatgactgtttcaaaagacacagtgtttaagatgtttaagtgcacagaaggacatatccaaaatgattccacaaaactgaaatgcagaaagccagattcttcaagacaaagactccaaattgttaccaccaaagcacctcacttctacgtggcgctctcctcttattacctcacctgcaagagctggaaggacaaagaaagaggaagggggaaaggaggaagagattctttccatttttcccaatgtcaacgtctgaatgaggccacacaccaccacacatttcaaagctatttaagaatttaaatggccaatgcccctataccttaaaaaaagctcccaatccccccagaaatgtgctggctttttttcttagtaagagtagtagcagaattgcttatggtataactttagggacaattcttgttctgggagtgagggggcagggtgttaacttaaccctgaacaacactgccttgtacgttcccaccggatgtagtagacaataattgcctggcttttgcaaacggaaaaatgaggttatgaaggggaagacacgggccctgggtcatgcagcaagtcactggcagactcatgggcaaatccagcgctcctggagacaaggctcagaggtgaatgacagcgaggggccctcaaatcaaccacaggggcaccatcttgtctgagccttcaagaccagggactcaggcagggcaagtcagagccaaggttggccatgaatgtggattaaagaaagagcctgaggggctcagtggccccctggcaccagcgccgctcagggtcatcctccacttcgcttctacagatgggctttctgctggagccccggggtatcaggccagcagcacagttacatgagactaaccccaaaccagcgcacccacaggtcaccctcagggtctccagcccagactgcatctctgctcaaatgcaggaggtgccctgtctccccagctacttggggcacagatacccctcaggcagccagccctgcaggtgacctctggaggggagaggaaacggggacttcttgctggagccacatccagagagtcgggcagctggcatttgggcctctctacccgtcctcactgctgctgcccctgggagggtcaaaggttcagatgatatccaggccccacgtgggattagcagcctaagcctcagctgagccagggtttcactggcttgtttaaagtggagcacagagcctgaccaagttgtggcatctccaaacctccttctctccgagggatcctccagggtgcctgacccccacgcctgtcggaagtggggccgagtgcccgcaggccggtgaagctgccttctgggagactcagggtctgagtatctggtctgagactctggtcttccctcgccctcctgttctacttcccatgccttctgtaaagtcctgccgtggcctgaagtgtagcccttcctggagtacacagcgagcatgctgtgccggctgtgggccccccacccccgagccgcaaagccccaggccgcctctgcctgctgcctggagacctggcactgccccacaggggcacccacctccagccctcctgcccccgtgactgaggaagcccagtgcttctcacactcctcagactcgctggctgagccaagcagccttggctgaaggaaagagcagcaaactgacccccacgggccgcgacctttccccacccaggcaaggcgacctcaggcacttcagggagcgccagctctggctttcttgtatgaaagtgacagcggatttaaaccacattaacaaaagaaatccctcctctctggactactcaaagcggaagtgctgccacatcctagctgcagcgcttctgggccaaatatcaagacagtgtctcagcgatgatccgcaaaccaaaataaagccgacaggaaacagcccgctggtttaggggagctggaatgcctccggcagcatcaaatgtcatcaacaactgacactcagcccgttcccggaggcctcttcacacgggaagaggccggctgcgaagtgcggctcagtgggggagaaggaccgtggggaccgcgacactgcaggccctggaagcctctccagcctgaaccgcgctgtggtccagcacactcatggcatgaatatggaacagtcactccaggaaacggtcttgctctgggggagggggaggacttccacatcactctcccaagataaaacaaccagggaaaagcagatccctccagataaaccagaagtccagacacagcctcctctccggaaacgcctccgggagcccacttcagaagctgctgaagcccagagaaaaaccgcagcctcgcaggccctggtcgccaccagctcgcccgccacttctcagtggaaagggacgtggtgccgatgggtccggggtctccccgccccgcgggagccctcagccagaacgccccaccagcacacacgcacacatgcacacacacaaacgcgcgcacacacacgcgcccacacacaaatacacacgcgcgcacacatgcatccacacacaaatacgcacccacacatgcacccacaaacgcacgcgcacacacaccgcccacacatggacacacaaacacaagcacacacaaacacgcgcgcacgcaggcacagacgcgcgcgcacagcagcagcagcgcgccggggcctcacgcccctggggagaagcgtgaaggagcctccacattccccggaaaggaagtttctgggcgcagcggagaaagggagatgccgagaccccgacgtcagtggatttgacacctgaagtgcaggcgcccagacagcctcaggcgcgcgcactcctgcaaacacgcggggcacacgctcgggcgcacacgcggacagacgtccctcggcgcagggaccccacctcctccgccgctaccagggaccggggccgctccgggcgcagaggaggcgcagggagccgcgttaccccggagccgactcgacccagcccgaggcccggggaggcggggaggtggggaggggccgcggagccggaccagccgttctccggggagcgcgccgcgcctggagggcgtctccgccggggtccccagcaaggatctgcggaggggaggcgggcgcgggagaggacagggtcgggccggggggtcggacgcgtggctgccggcggacactcaccgatcttgatcttcacgctctggaagacccggagcccctcgtcctccaccgccatgctgcgcgtccgcgcccgccgagcctcgccccaagcgcgcgccgagcccgggcagctcaggccgagcaggaggagcggcggcgccggagccccgagcgcggccgagggtccgcccgcctgcaagaccgcca

SEQ ID NO: 2216 - DNA, 85623 bp, Homo sapiens
tgggttagttcctgttaggccccggccgggggagtaggttgaagtctcctaagatgcccggtgggctggggcaccgggagctgtgaagggaacgtgagggggcggcgtagtggagacccacggcaggcctgaagaagagcggcggccgagcccgccttccctgcaccatgctcatagaggatgtggatgccctcaagtcctggctggccaagttactggagccgatgtgagtgagccgggctgggccggggccggcgaacgtgggcgttgggggctcgcgggggcgtgggggaggggaggtggcgtggggggcggcgctgaggggccgcggccgggaggtcccggcgacgccttccctgtagtactatcaccattgtggtgggggtgagggtgggagaggagcgctggggacggagaggcgccgtgaatatggggactgggggggcaggcaaggacagcgaaggcttttcaaacgcaaatatcggggtgctggaaggggtagcaggggccgtgagggaatttaaaacattgctgtttgagaactgagagagaggtaacggggctcttgagggatttttaaaatgtgaatattgagatgtcgaagggaatagcagaatatcaagggtttgataaacattattattccgggactgaaaggtctagaagcaaaatatcgagggcattttcgaaatatgagggcagaagcggatagcagggacattgaaactgtatagcgattattggtaagttctgagggatcaagaatattgaaggatttgaaaaatactatggagtagatgaaaaggatgtgtgggcattgaagggttttagaaattattggggaggtgataagtgtgatagcaaggatattaagggattttaaagtattattgagggcttgatagtgctaggggaactgatgacttttagatacatagaggttggaaaaaagaggtttctgtaagtttagttgaaggttgaaagggctacactggtatgcagcattaattggtggaggagtatacctaacagtatgtagggatttttagatacaggtggtgttggaggaataaaaggagcggtagaaagaataagagatttgtaagtattcttgtgccattgagaggacagttttgtaaatgtttttgtaagattgagaggacacctgaagataattggggtgtagtatgagggaccgaaaagaatgagagacctgtcttttaaaaatattttgggtggtgttagtagaaatgttattgggaggcttgaaagaggtaacagatgtatcaacattttgttttataaccttttttttttgaaacaatgtctcgctgtgtctcccaggctggagtgcagtggctggatttcggctcactgcaacctccgcctcccgggttcaagcgattctcctgcctcagcctcccgagtagctggaactaccggcgcgcgccaccacgcccagctaatttttgtatttttagtagagatggggtttcgccttgttggcgaggctggtctcgaactcctgacttcaggtgatccgctcgccttggcctcccaaagtgctgggattacaggcgtgcgccactggacccggccatgtttgataaccattttaaagggtagagttgtggagtgcttatttgggggaatggggtatggctagttactggaagggaaagaatcatgttttgcctcctccttgcttctgctttattattctcttattgaaggttagagctttctgcttgaaagaaaggggtagaagaagagatgggcaggctttgattcattaggtcagattgcattagtggaaaatttgagtgtttttcggaggtgaaaatagggagtagtttgggaggtgtggaggcatggtaaaggaacttctgggggacagtgtcaagctacttccctgttgatctctttcagtgaaaatgactgaacacacttgaaggttttgtagaagaatataggtctcttgaataggggtttttttaactcctacaataaagttttgggcacaaagatggaaatggtttgtggtgaaggtgggaaataagatggatgtaatgaaattgaccatatatgggaaaaggttgaaaaaagaaaaatatctgtatgtttaaagtattcttcatgtggctgggcacggtggttcacgcctgtaatcccgacactttggggggcctaggcgggcggatcatgaggtcaggagttcaagaccagcctggccaatatggtgaaaccccgtctctactgaaagtataaaaattaaccggctgtggtggggcgtgcttgtagtcccaactactcgggaggctgaggcagaagaatcgcttgaatcccaggaagtgtaggtttcagtgagcctagatcaggccactgctctccagcctgggcaacagagccagactccgtctcaacaaaataaaaataaaaaaagtgttattcatgttatttaagattaaaaaagaaaaaatacatctctttattttgtatttctgctgctctgatgcctttagaaaaaacaacctactttccagacaagtttagttttgttggtagctatccttttaagaagaattaaacatacattttatgtcttggatagaaggtaacaacttttagccttatagttacttgctttttcttttttttaaagctccctaagatgttttactctgagtagtgcttttcgttttttgtttttttttttttccccttaatgttgaaggttagtctgggtgggagcttcttcttgcttaggcttttttttttttccttcttttttttaaagctacttagactcataagtatgatcattctgtaattttcatgagtaaaaattatctttcaaaatgattacttgagtttagtttctccttttgagttatatattcaacttaaagttcacatgcttattttttttaattttgttgctcatttagggtaaaaaaaaaaaggctaaaatactttatttgtttgtttatttatttattgagatggagtttcgctcttgttgtccaggctggaatgtggtggtgcaatctcaggtcactgaaacctctgcctcctgggttcaagcgattctcctgccccagcatcacgagtagctgggattacaggcacttgccaccatgcccggctaattttttgtatttttagtagagacgggggtgtcactgtgttggccaggttggtctccagttcttgacctcaggtgatccacccacctcggcctcccaaagtgctgggattacaggcataagcctttgtgcctggtctagaatacttatttttaactcacctaagtaacagttttgaatggagatattaataataaaaaagtaaatgcagataccacatatatttttattcttagtatgtcatcatgggagattattttttgtttgtttagatatcctaaaatgtaataaatgatatgctaaagtgggttgtgtttgtaaatttacttttttgcatattccagattcaagaaaattttcatggcagattggcatgttgctacaacatagcatttcagagcagttgctaggctttgagatagtatagttgcaccggctaggttggaatcaaactatgactgtgcacatgattttctttctttttctttctttttttgaggtggaatctctcactgttgcccaggctggagtgcagtggcactcactgcaacctctgcctcctgggttcaagcgattctcctgctttagcctcccgagtagctgggattacaggcgcccgccaccatgcccggctaattttttgtattttttagtagagagggggtttcactttgttggccaggctggtcttgaactcctgaccttgtgatccacctgcttggccttccaaagtgctgggattacaggcatgagccactgcgcccagcctgtgtgcacatgattttctattacattttcttatttagcttagtttacagtaaattaaatttatgaaagcttccaattcccgggggatttttaaaatgttacatcttgtccctagtgaaacatatgcatgtaacgggagatatttcttttttttttttttttttgagacagggtctctgtcgcccaggctggagtgcagtggcacgatcttggctcactgcaacctccgtcttcggggttcaagcgattctcctgcctcagcctcccaagtagctgggattacaggcgtgtgccaccatgcctggctaatttttgtatttttggtagagatggggtttcaccgtgttggtcaggctggtcttgaactcctgacctcaggtgatccgcctcccaaagtgctgggattacaggcatgagccaccacacctggcctaacaggtttttttttttttttttttttttaagacggagtcttgctctgttgcccaggctggagtgcagtggcgtgatcttggctcactgcaacttctgcctcccgggttcaagcaattctcctgcctcagcctcctgagtagctgggattacaggtgcccgccactacgcccagctaatttttgtatttttagtagagatggagtttcaccacgttggtcaggctggtctcaaacccctgacctcgtgatccacctgcctcggcctccaaagtgctgggattacaggcgtgagccactgcgcccggccaacaggaggtatttctaaaccaatctagtttacagttgattattccctatggacaagttaggaatgtcatgggctattagagcttatctgttaccttccattccctttgtaggtggcgaacatgtctattacttttattagaggaaggacaggagggagacaggaagaaatgactccttaactggctggaatagactagtaccaccatttttgttggcaatgcagtaaaagggagggaaaccaatatctcagtcgagaagtttgtctctttccctacagctgcatgaatagactagactcagttcttgtttggggacttcatctttcctcagtttcaaaatatcctggatatcctagtcatagagactgtagggattatgcacaatttagagatgtcatggtttctttctgtcagaaataactgctcattgtaagaatgtgaacccctttaaagtaaggttctgctaaattcaggaaataagtgcatcactaaagaaatttctgcaagtttaaaaaaagatcaggcaagcatttttcagtaacctgcatttctatcaaaacatgttgtatttaatggggaatgttttatttatattatataaaatgtataaatatgtattattcactgctgcttgtttggcttagtgtaaaactttctcttggtgtgtgttttaaaaagcatggtgggatttgtaaactctggacaatttgtctgtcttactttaatagacattgttgtgtgaatcggcatttaatttctagttccgtatctatctctaattcactctgtgacttaggataagttgtctaacctttttctattaaacagaactaaattttatttgccttttacctacgtcaccaagtctgttatgagtattaatgatgtagactttaagtggtttgtgtacctctgaatcattctataaatgtaaacaacattttatggtttttggaatatgaaaatacatgaaactttctgcaaaagtattttgcttattaatgttaaacaccactgccacttaaaaaataataatcagtctattacaagacagactagagtctcattgcaggtcctataggtaggaacaggaattgctagtcaaagtcatagacttgatgtgcagtttttgtgatttctggccatatcagtgtcttttaaagtgccctaggagattgaatatgttgtcagcttggagagtgatagaaaaggcagcaataaggttaatagactaagtttattttattggttcatatttatgggttcagtgatcatgatgcatatactttggttgaactctagagtttacatgttgctgtatgttggcagtccttatcaaattgaactctggatagtaatctctgcagttgcccaaatgggaggaaaaataattatctagcaatttttggagctgaccacctggtaaataaactaccagcgttaaataagtattttggaggtatattcttaagtttgggaagtactggtaattttcgaagtgtacttagttgcttcagagaattagtgtgtctctaaagtgctgtgggacttaaggataccattcactatttcatagaaaagaactttggccagaagacttcttggcaagttttagtctactaacttaagaacatatttgttcttatgtcctttggtctgccttttaaagatgtctgacttcatccttcctggcccaataactataggctaaagccagaagttgcctttttagccctgtgtttcttgccactgtcttctcttatcctcttacagtgttgctacttacttccttattaatctctttttatacaatgtattattttgtactgtaattatttgttttcgtatccacctcttggccatgggcgtgcagggcaaggtctgttttgtttaaagtaattccattaccaagcaatatgcttggcacttagtaaacactcagtatatgtttaaatgaatgaacattctcatatgtatatacaggtaattgacaattagaaaagtaagaattttttagtagtctaattttgtgcatgtatttagctagtggctactatactaggagctatggtccaaatatccaaatggtatttgcaactgatgaatgtatgtatatattttcctcccaaataaatctagggttatttcttccacatgatactcattcatgaaagcccctaattacttaaggggaagatgaaagtactatggtctgaatgttggtgtcccctcaaaattcatgttggacatctcaaaaaaaaaaatatgtgaaaggagcctgcttgttaccatgagaggacacagaaggtaccatctgtgaagaatgggccctcactagactccaagtttgctgatgctttaatcttgaacttcccagcctgcagaactgtgagcaatacatttctgtttatagccgggcacggtggctcatgcctgtaatcccagcactttgggaggctgaggcgggcagatcacgaggtggggagatggagaccatcctggctaacacagtgaaaccccgtttctactaaaaatataaaaaattagccgggcgtggtggcgggcgcctgtagtcccagctactcaggtggctgaggcaggagaatgacgtgaacctgggaggcggaggttgcagtgagccgagattgcgccaccgcactccagcctgggcggcagagcgagactccgtctcaaaaaaaaaaaaaagaaaaattctgtttataaattgcctagttggctgggcattgtgggctcatgcctgtcatcccagcactttaggaggctgaggtgggtggagcacttgagtccaggagttcgagaccagcctggacaatggggcgaaactctgcctctacaaaaaaataaaaaaaatagccttagtcaggcatggtggttcacacctgtcgtcctacctacttgagaggctgaggtgggaggatcacttgagcctgggaggttgaggctgcagtgagctatgatcaagccactgtactccagcctgggcaacagaatgagaccctgtctcaaaaaataaataaatactaaattgcctagtctaaggtattttgttatagtagcccaaacagactaagagagaaagttttcatttgaaaaaaagtagaagtaccaatatatgtgtatctttaataaatattaacaaatgtgaaagtcaactccatttttacttactttgtccagtatggtcttatcttttttttttttttttttttttttttttttactttgagaggagtttcgctcttgttgccgaggctggagtgcaatggcatgatctcggctcaccacaacctccgcctcctgggttcaagctattatcctgcctcagcctcctgagtagctgggattacgggcatgtgccaccacacctggctaattttgtatttttggtagagacaaggttgctccatgttggtcaggctggtctcgaactcctgacctcaggtaatccgcccctgggattacaggtgtgagccgtcaggcctggcccagtatggtcttaccaaagggataatctgaacacagatctcagagtcagactttttttaaaattcactttcattcttttaaaataaaaataagcgtattattgcattatgacagtatagaaagtagagaaaagaaaattattagtatttattttgtttttcttatgtgtatgaatttttatatagctacagtcagactcattgtaaaattctgatttctttgacattacatcagaagcatttttcacatttatatattgcttttataaccatcactttggtttttttggtttttattgttcccgccacccccgagatggagtcttgctctgtcacccaggctggagtgcagtggcgcaatctcgactcactgcagcctccgcctcccgggttcaagtgattctcctgtgtcagcctcccaagtaactgggattacaggcacgcgccaccacgcctggctaatttttgtattcttagtagagatgggctttcaccatgttggccaggctggtcttgaactcttgaccttgtgatccacccgccttggcctcccaaagtgctgggattacaggcgtgagccaccccgcccggcccttgttttttattaagacagggttttgctctgtcacccaggctggagtgcagtggcatggtcatagctcactgtagcctcaaccttccaggatcagacaatcctcccacttcagcctcctgagtagctgggactataggtgcatgccaccacaccaggctaatttttttattttatttttttagagatggaggtctcactatgttgcccagactggtcttgaattcctgagctgaagcaatcctcccacctcagcctcctgaagtgctgggattacaggcatgagccactgtgcctggccataaccataattttttaaaaaacatttgtttattgtattatattgtattatagtatattacatatatattttttgagatggagtcttgctttattgcccaggctggagtgcagtggcgtgatctcagttcactgcaacctccgtctcctggatggattcaagcgattctcctgcctcagcctcctgaatacctgggattacaagcacccactaccgtgcccagctaataaccatcactttggatgcctaatatttcacaaacatccaacaataagagaatggttaccttggcactatttttttgttaaaaattaatgctgtttttatttaataaatatattttgtgtgtgtatagctttaggtactagtaatattttctatatatgcctttatttccttcgtctagtttatcataagtgtaactactggtcagagaatatggattttttttgttgttgttgttgttgatatggagttttgctcttgttgcccaggctggagtgcaatggcgtgatcttggctcactgcaaccaccgcctcccgggttcaagcaattctcctgcctcagcctcccgagtagctgggataacaggcatgcaccaccatgcccagctaattttgtatttttagtagagatggggtttctccatgttggtcaggctggtctcaaactcctgacctcaggtgatccacccttggcctcccaaagtgttgggattacagacgtgagccaccacgcccagccaagagtgtggatattttaatggctgttgatacacattgagatcaggagattttttttttttaagctgtggctcagaagcacatgtattagttgtttcacctctgaaagaaagagcacattaagatggaacttaaaattagatccatattcagaaacatgtaaatttttctgcaagtgggaaaggtctaagtagtcttggcttttttcctaaagcaagtaaatggtaatggtttttcagtagtgttttttggcttggggccaaaggtgtaggaccttactctttgatcttatgattgcatgtctgaaattttctatgaagcttatgtactggctcagcagttgtgtaatatacgtgcaatagagatttcattaaaaggggaaaaagataaatttgagatttttacagatgaggtatttttagggcaatgtttctattagcttactccgataaaaatttgttgacttttattttttaaataacttaaaacataattgaagcatgttcttaaaacgttattgtgcaaggtgtgaattttaaggagtcctatttgtaagttacattaagctttaggaaatttcttttgttgattctttaaaaggtaactgttggttgatacttaagatacattaatttttcctgcagatgtacattagaaaaagacatggttgtgaaacagattttacttgtgtggaattgcagctgagttttagttccacagatgtgctgtctgcctgatcttaaatcgatctcttaatttatctttacaaatttacaaatctatagtagaatggtaatttaagatggatattattaccttttctaatctccatgttataataaaagtccctttttgtctagagacatgtgtattttgcatagtcatggatcccaaattttacaatctctttcatccccaaatatgcttgtttttatagtcaagcagtaatggattcccataagctttagttgcaaataaagtggctaaaagattttaagtactcttcctgagtatgagaagaaagaagtgatgatttttcaggagagggaagtgatgctgcacttgtcttatattctcaagagtcttagttgtactcagatttttgtgacatacttctggaagtcttgttgagtagttagcattgatactgtagctacagtatcatggctgttttttagagattatatagtgaggggtcaatgggtgaaagaataagaataattgtaaaagtctagaaaattacagcacaaaacttcccaatgtatttaagtttcaccattcaattagtgtgaattattcaattagtctattattttagacttataattttcttcagagcgtactttatggatacatgttaggagctgttaaatgtaaatggtcctattcctttggctgtaaacatgctgttgtatttggtgcagatttctgtcagttattaacaatcatttgttccctcacattaaacaaatgtttagaatctgtgatcattctcttctcctggagtctaaccttttctactcttttactttcctgtatattcatcttgatttttagcactatcatatcaaaatgtgtttcatcagaagcagcctaacttggcatatggtttttagagtctgtatgctaaatatatgtaaaagatatctgggtttcttttctttttttttgagactgagtcgcgctctatcgcccaggctggagtgcactggcgtgatctcggcttgctgcaacctctgcctcccaggctcaagcagttctcctgcctcagccacccaagtagctgggattacaggtgcatgccacaacacctggctaatttctgtatttttagtagacatggggtttcaccatgttggccaggctgatcttgatctgctgacctcaggtgatcctcctgcctcagcctcccaaactgctgggattacaggcatgagccactgcacccagccgatatctgggtttcttaaacccatttcagttatccaatatctgaatgttttgcccattcctaacatatagaaactttattatccatacccagcactaaatctatcagatcattagactccttgaaggttcctataacgtcagagaaaataacattgccattttcttccattcttatttatttttctaagtccttttcttctgtgttagactacccttatccaagaactaaactttttaagtaaaggtggaaatgtaatttttttccccttctctcctccatatgaatgtagactagaactacactgataaaaattttctcattattctcaggggtgaaattaagttggcctacacatctgttttttaaggtgtttatagaatagccagggtaagcatggcatgtgtaatttttttttttttgagactgtctctctctgtcacccaggctggagtgcagtggtgtgatcttggctcactgcaacctctgcctcccgggttcaagtgattctcctgcctcagtctcccaagtagctgggattacaggtgcacaccaccacgcctggctaatttttgtatttttagtagagacgggatttcaccatttgggtcaggctggtcttgaactcctgacctcgtgatcctcctgcctcgacctcccaagtgctgggattgcaggcgtgagccaccgcgcccagctggcatgtgtaatttttattttattttattgagacagtcttgctctgttgcccatgctggagtgcagtggcacaatctcggctcactgcaaactccacctcttgggctcatgtgattctcccacctcagcctcctgggtagctgggaccacaggtgcatgccaccacacctggttaattttttgtagaagcaggttttcaccatggtctaaaacttctggactcaagcgattccccacactttggcctcccacaggtgtgagccaccacacccaaccataatattttttgaagatagaaaggctacatattcactattttggtttttaatttaaaattttattaataaaaattgtatgtatttaaggtgtgatgttttgatatatatgcacatgctgaaatgtgcatatatatcaaaagctagttaacataatcatctcatatagctgtctttttttgtgtggtgagaacacttaagatctactctcttagcaaattcaagtttacaatatatttatcaattttagaatttaacagttggccttactaaggttatctgttcataattctccaaaatgtaacattttttacttaagaaaaatctttactttcttttattttttattttttgagacagggtctcactgtgtatcccaggctggagggtagtggtgtggtcatggctcactgcagccttgacctcctaggctcaggcaatgctcctgtctcagcttccttagtagctgggagtacaggtgtgcgccaccatgcctggctaatttttatattatttgtagagaccggatctcgctatattgcccaagctgctcttgaacttctaggcttaagcagccagccttggcctcccaaagtgttgggattataggcatgagccaccaggcccagccttgagtgactctctgtctatttatttatttggagatggagtctcgctctgttgcccaggctggagtgcagtggtgcgatctcagctcactgcaacctctgcctcccgggttcaagcgattctcctgcctcagcctctggagtagatgggactacaggtgccagccaccttgcctggctaatttttgtatttttagtagagacggggtttcgtcatgttgtccaggctggtcttgaactcctgacctcaggtgatccccccgccttggcctcccaaagtgctaggattacagatgtgagccaccgtgcccggccaggtgaatggatgtttaaagaaccagcctttcccatgacagtgttaatattgacaacaaaaaaagttgtgttactgaattacgaactttaagcataaaaactagaaggaagtaaaggtactggtgcttggtttttattttgtttactaatctcataaagttattggaaatgtgattgatactcttgagctgaagcctgtttttttttttttttttttttttttttggagacaaggtctcactctgttgcctaggctggactgcagtggcatgatcatggcttgctgcaacctccaactcctgggctcaaggtgtccttttgcctcagcctcccaagtgagctgaaaccttttaactttctggctgctagtgaaggcccaaggattatagaacaagattagttagatttgaatagtgttttataggttatataatcactttgcttgcataatggttttacttactgttattctgaattttttgtttgtttgtttgtttgttttttgtttctttgagacagggtctcactctgtcacccaggctggagtgcagtggtgtgatcggctgactgcaatttctgcctcccagcctcaagcatcctcccgcctcagcctcccgagtagctgggattacagacgtgcaccaccacacctggctaatttttgtattttctatagcaacagagttttgccattttgcccaggctggtcttgaactcctgggctcaaatgatcctcctgcctcagcctctcaggatgttgggattacaggcatgagccattgcacccagcctgaatgttttcattttaccttcataacctgactgtgaaggatatgtgttatttatgtattcatcaggaagcctagaatattttatatatgtgtgtgtatatatatatgtttacaacaagaaaactaaaagtttcatgtgatgtacataaaacctcgagtctgacagattactatacatcaggagttgacaacccaaggattatgagctgtcctggaataggagatgattttgagtatcagtgttggattacttactagaaaaaatgagaagtagataaaggttatctctgctgtcctttcaccacttctcttttcctttctgtttctaactcctagatcttttctttctttcttacagctgctaaagcatttgccaataatatttaaatgccattcttttcatgttcttattttttaaaaagatctttaagatactcgctgagattagcaaaagggctgatagccatttttagatactggtgcctagggagaggtgtcttgaggagaggagaaagtttttccatcacttcccttccttttgctcattaatcacctggaacagatagttcctgaaggtgttattgacagtgcttctatagctgggagccaaacagcaacttaggggtcagttgccactctttgcctgttatcattgagagaacaaataaatgtagagctcgcccaagatccttgatatatttagaacctcaaaaatagaagacatactagtcattttgtagaaataaatgcaaaaggaaaatctcgcagtatgtatatgtttattataaaagttgcctgtgtttgtggtcactttttagaatagagttttgatttctcgttttccaaaataagggtgacttcattaataacactactgtttgataaaaagtgttttttaaaatttttgttttctctttgtctaactagatgtgatgctgatccttcagccttagccaactatgttgtagcactggtcaagaaggacaaacctgagaaagaattaaaagccttttgtgctgatcaacttgatgtctttttacaaaaaggtaattattatgggccttcaatcgagtattgaagtaaagattttaagtttaaaacttcctgaaaagtcttggagatataagcttgataggaaagaaagtagtcagagtcctttgaatacttgaatatacccattcatacttaattatttatcatgttttgttagaactggttttttccctttccttctttgctgctttcctctattgaggcaatggcagctctaatgctttttagatgattaggtcttttgcagcttttgacagagcctacttgatgattgaggggtaacagtttaaggataatgaagatgcttattcttggtgttcattaagatgatgagctcatcagtttttttccccccttggatggggcttcttaatatccaagaagagatgtgtatgatcctcttctctttgtgcctttaacttttcatcttcttaccaaatctgtttccatggtctacagagcttcctaaggtttcccctgttgcctctctgaccttatctcctatcattgcccctcacttgttccactctagccacaacgaccacctgttttttgaattatggcaaacatgttcccaactcaggccctttgaactcattttacccttgcctgaaacatggattcttctctcgcttctttctggtctcttcaaatgtcatcttctgaaagcagtttcccctgagtgctctacatacagtgtagtatactccatgcctccatccactctcctccttccaaccctgttttgttttatttttcttttttatttatttatttttatatctatgtatttttatttttgtagtgttggggtctcactttgttgcccaggctgatccttgaacttcttgcctcaagcaactgccccaccttggcatcccaaagtgctgggattacaaggcatgagcccctgtgcctgactcctgttttgttgttttcatggcacttgtcaccacctgtcataggtttatttgcctggttatctgtctctctaccctttgtttgccttttgtttggttgagagtggagacttggaacctacagtacttggtacatggaagatgttcagtaaatattgttaaatgggccaggcgcggtggcttacgcctgtaatcccagcactttgggaggccgaagcgggtggatcatgaggtcaagagatcgagaccatcctggccaacacggtgaaaccccatctctactaaaaatacaaaattagctgggcgtggtggcgtgtgcctgtagtcccagctactcgggaggctgaggcaggagaatttcttgaacccaggaggcagaggttgcagtgagccaagatcgcgccactgcattccagaatgggcgactgagcgagagtccatctcaaaaaaaaaaaaaaaatatatatatatatatatatgtatgtatagttgaatggatgaataggaatgtgaataatacacatttatcagttgatttagctattggtgatgagaagatatcatttaaaataagtatttactgagaaggagaaaagtaagtatggcttctcaatctaaaacataggattacatattttttcctacattttacagctctttttgtagaaacaaagcaatactgacagaattttttcccagtacaacagctacttaaaaaattcctccccagtacagatgttttcttttctaaatgtgttaatttacattacttgatttacattaaagatgagtcttgtgaaatgtagagccatgacaaaagagaaagcaaaacatatttggggtaaaaggccaaatgaatgtttagacgtccaagaattctttgttataaaaagttagaaaggattggccaggcgcggtggctcatgcctgtaatcccagcactttgggaggccgaggcgggtggatcatgaggtcaggagattgagaccatcctggctaacagggtgaaaacccagtctttactaaaaaaacacaaaaaaattagccgggcatggtggtgggcgcctgtagtcccagctactcggcaggcctggacgacagagcaagactccatctcaaaaaaaaaaaaaagttagaaaggattttagtaattaaaaaaaaaattacataggtaatatatatgagaaggaactatacactacatttttaaaaggataagaaaataagtaaccataaatttgccaccagagataaaatcactgttatcagcttgtgtgtgtctttctagactagcactgtccaatagaactttgtgcatatggtctatatctgtactttccatttcagtagccattagccacatgtggcttttgagcacttgatatctggtaaataggccagagaaattgattttttttttgagacagagtttcgctcttgttgcccaggctggagtacagtggtgcaatctcagctcactgcaacctctacctgctgggctcaagcaattctcctgcctcagcctctcgagtagctggaattataggcatgtaccaccacacgtggctaatttttgtatttttagtagacagggtttcaccatgttggccaggctggtctcaaactcctggcctcaagtgatccacctgcctcggcctcccaaagtgctgggattacaggcgtgagccactgtgcctggccagaaattgatttttaaatttaattttaattaatttaaactcaaatttaaagagctacatatggctagtggctactatattggacagtgcaactgtagacttatgtctgtgtttatattgcatcttaaaatagtattaagtgaacatactcttttataataacattttaaaaatttaatagtgtaccttgaatattgtttttatttttatttatttttaatttttcccaaactctttggtttcccagagaatattgtttaatagtagatgtttatctttgctttttaaaaattgagctatgtgtctttcagattacaaaagaaaataacatgttataaattgttttaaataataattataagtgaaagtattctgattatagaggcttttgaagggtctgattattgtcttaagtttatatgtaatagtcaatgagagctaacagttttataatcgtggaaaaatgcttactacacaaattagtagtgtaaagaaatttataagaagatgcttttctgtagaaaagataacattttagaaatagcttttatgtaaaagatgtaatcattgcaatgtaagcagagtttgtgttgtgcttttaatatgctctttagctgttccttagggtaggaccaatcaaagttatttagatttggttttaataagacataggctggatgtggtggctcatgcctgtaatcccagcactttgggaggccgaggcaggcagatcacctgaggtcaggtgttcaagaccagcttggccaacatggtgaaaccctgtctctactaaaaatacaaaaattagctgggcgtggtggcacatgcctgtaatcccacctactcaggaggccgaggcaggagaatcacttgaacccaggaggtggaggttgctgtgagctgagatcgcaccactgcactccagcctgggcaacagagcaagattctgtctcaaaaacaaacaaacaaaaaaaagcagtataaatatttgacgttaatacttttactaaattcatctggttctcccattcagttgtctgaggaagtttcaaacagagcaccctttaagtaaaacacaaaaagttagtttcatgtcattttcatatcagtaaatatttaactgattaaaaaaaattttcggttaagttttttgagttggcagtgcctttaatccaacaatataaaggtataccatgaaagtctcttacctgttttatatccaccgcgttcccacctagagtacacaattttgtcagtttttatttttttcagtttctttatgcagatagatagaaacacatataaatacatactgttatatctttgagatcaggtattatcagtattctttctttttatagccgctgtgtactctgttgtatagatgtcccatagtttatttaactagtctcttattcatggaaatttgagttgtttccgatcgtttgctattatatcctccaacaaataatcttacatatatatcattttgcaagtaggtcagaaggatttaaaaacctgaaagtgggattctcttccataaggtaggactcatttttagtcctactagcagtgtacaagatgtcctgttttcctgagctttgctgacaatgtgttgtcaaatttttgttttttgtttgcgcaatatgtaaatgttatttcttctccttagaaacttcaggttttgtggacaaactatttgaaagtctctatactaagaactaccttccacttttggaaccagtaaagcctgagccaaaaccactagtccaagaaaaagaagaaattaaagaagaggtaatgcaaattttttctcctgcttttgggggcttcttagatcctgtcaccagtatccttagttggaagttgagccttttaaaagtaattgtgtattgattcaagtttccggattttaggcatggtacagattcttcatcaggatttcatagttgcttggactgaagagttgaaaagtttcagatagcttgtttagagatccaagaaatatttcagaaatattgaggaagtcagagaaatcttatctagtgacttttagaaaaagaaaacttggttaaatatagagagattgactgaaagtgaactgttaacaaatcctcaagagaaatcattaggtaacacattttcatgtatatggagaaaccagttgcactttttgattatatagagttttaaaaaatagttaatgtaattgtgaacatcactgtcaacattggaaagaggattttaaaaatgtttttataatattgaagtatgaaaacatggttatagatggtaacctaattgtttgaaccaagaaggaaattttacagagttctttgtacttcctgttatatacagacaatatagtatagaagaatgtggattctgtaatcaggttgcatgagttaaaataacagctctacaagttaacttctctgtctcactttgatatcagtaaaatgaggatcagagtagtacttattgaggattaagtgagattatgtatgtatgtgtgtatatatatatatagtttctagtccagtgcctggcacataaatgttggttatcatgcagaaatatttcccagtatttatttttattacatttattctgaaggtaaaatgaatttttaatttagaaataattttaaacaaataaaaattacaagaggctgggcatggtggctcatgcctgtaatcccagtactttgggaggcttaggtgggcggatcacctgaggtcagaagtttgagatcagcctggccaacatgggaaaccctgcctctactaaaaatacaaaatattagttgggcgtagtggcaggcatctgtaatcccagttacttgggaggctgaggcaggagaatcgcttgaacccgggcagtggaggttgcagtgagccgagatcatactgttgcactccagcctgggcaataagagcaaaactttgcctcagaaagaaaaaaaaaaattacgagaataatacccaaaacacccatatgacgtctatctagataaacttttcttttcgatggagttggagtctccttatgttgcccaggttggtctcgaactcccacctctgcctcccaaagctctggggttataggtggtctagatatacttactgaaaatttgccccatctgctctctttaaatatccatatgatttttttctcagtaatttgagtagtgagtcacatacttcatgtcttttcacccctaagtaaagtacttcagtgtgtatttcctacatataaggaatattctcttaggtaactatgatactgtgatcaagttcagtaaatttaacatccatatagtactttaatgtattatctgtgttcagttttatcaattgatcaagcaatgtcctttttttatttccttttaaaaaagttttttgttgttgttaaagagacagggtttcactatgttgcccaggctggtcttgaactcctgagcttaagcgatcctcctgacttggcctcccgaagtgctgggagtacaggcatgagccactgcaccgagtcccaagtgtttcttttttatagcatgttcttttcctctccattttcaggattgattctaaggattaggtatcatttagttatcatttccgattcatttttaaatgctaggctgattgacctgatccaacattaaaagaaaaaatgtggctatatttatgaagatcaactgagactgctgtctgttttttctttttatatcatgccctgtaattatctcatcaagttctttcaaaattggagaggcttgttgaatgtgtcttaaagtactggaaataggaagaagcctttctgttttttacctttctgtttttttttttttttttgagacggagtccgctccatcgcccaggttggagtgcagtggtgccatctcagctcactgcaacttccacctcctgggttcaagcgattctcctgcctcagcttcctaagtagctgggattacaggcatgtgccaccatgcctggctgatttttgtatttttaatagagatggggtttcaccatattggccaggctggtcttgaactcctgacctcgtgatccacccaccttggccttccaaagtgctgggattacaggggtgagccacagcagctggccacctttctggttttttttagacagagtctcattctgtcacccagggtggagtgcggtggcgcgatctcggcccattgcaacctctacctttcaggttcaggcgattattctgcttcagcctcctgggtagctgggattataggccctgtcaccaagcctgcctaattttttttttttttttttcagtagagacggggtttcaccaagttggccaggctggtcttaaactcctgacctcaagtgacctgtttgcctcggcctcccaaagtgctgggattataggcatgagccactgcgccagggctggaagaaaactttcttgagtactttcatagacatttttctttggtactttatagtatataatttttggtctatggtatagattatgttttttataagttaaaattttttgtaacgtgttttttacagtcattgaatctcagtggtttagatgtatctgtttgagaggcagctgatttgaatatgagagaaaatttgcattatcttgagtttatttatttatttttttgagatggagtttcattcttgttgcccaggctggagtgcaatggtgtagtctcagcttactgccacctccacctcctggattcaagcgattctcctgcctcagtctcccaagtagctgggaatacaggtgcccaccaccactcctggctaatttttttgtatttttagtagagatagagtttcaccatgttggccaggctggtcttgaacacctgacctcaggtgattcacctgccttggcctcgcaaagtgctgggattacaggtgtgagccactgcacccagcctgtcttgagttttaaaagaacagttttaaaaaaaaacaaaactgttatactatcttgtttgtatctttgtagatacaattttgagaattgtgaaaaatggataatgccagtttctgtgtagagctacccccaactgacagctttccggcgtttctcattttctaagttttagaaaattacataacttatcgtaattactgaaataaattgtagttcatttagtagtgcataaacataattgtttatagtatttctgttagataatagagtaggaaaggagtctgaggtggcacacatctttggctaattgtctttttctggtctgtgcttagttgctctgaacagggtatagagaagcaaatctagggattacccattttaactttcttccttggtcttcggctacattgggttccattagtggttttctaattagactgttgatcaccagggtaagagaatttggatcattggcaccaactcatcctgcttctggaaaaacaacttggtagacatgtgccatgatttatgaagcacactgccttcattgcctgttttctttacctcatctttttccttaaattttattttgtgaagaaattcaatcatttgtcctgtagagttttttactgtctggattttgctgtctgcatcccagtggaataatacatcctctgtatttcctgtgaattaggatagagaatgttttttaaatgtagtctagtgagtgtgtagtgattttgctgccatatggttgccatattgtggctgccgttttatgttgcctgaattttattaaattattatctcctaagtccattcactcacttcctgatttgtgtatttgtcagtgagcttctccattagataggtatttgtttaactcttgcaaataactttatttcacctttctctggtaaagactatatattcggtttgagataaacttgttcaaagacaataataaaaattactggttctccaggaggcagaggttgctgtgagctgagatagcgccactgcactccaacgtgggcgacagagtgagactcggtctccaaaaaacaaaagaataaaataaaaaaataaaaattactgttctctttgtatttctggtcaattttgacggttaggctttaagagaaagccttaacatttccattagttccaataccatttttccatagtttacatgaattacttagttttatagcattcattgatttaaccattttttcctaaaacgtttcctatggaataaatctgaagagctactcaaatgaattatgtatgtatatatatttcataatgaggaaaacataaccgttttactctatggtacttaagagatttgctgttttaatttgaagaatgaattgtttatacttttcctacactaccattccctactttaacattaaaaaattaacaaactgcttgttgaagtaatctgagcatcttttttatttctgctgttgcctgactcttttggctatgaattgactttattttttcagtgtatttactcgtgccctctcttgcgccagaaatattatcaggtagatggacatgtttcataatttatagagggaccattctttcttttttttttttttttttttgagacaaagtctcgtgttgcccaggctggagcgcagtggcgtgatctcggctcactgcaacctctgcctcctgggttcaaatgattctcctgcctcagcctcccgagtagctgggactacaggcacgtgccaccacacgtggctaatttttgtatttttagtcgagacagggtttcaccatgttggccatgctggtctcaaactcctgacctcaagtgatctgcccgccccggccacccaaagtgctgggattataggtgtgaatcactgcgcccggccgagagggaccattcttattttgttttttgtttgtttttgagaaaggtctcactctgtcatccagcctgtggtgcagtggtgtgatcatggcttaatgcagcctcaaacttctgggttcaagcagtcctcccatattggcctcctgagtagctgggactacatacaggtgcatcccaccatgcccagctaacttattttatttattatttttagtagagatggagtctccctgtgtttcccaggctggtctcaatatcctggcctcaagcagtcttcccacctggacctcgtaaaatgttgggattacaggtgtgagccaccgtgcctggccctgctcttacttctactcaatattttcatataggtatttcaggagccagcagaggaagaacgagatggcagaaaaaagaaatatcctagtccccagaagactcgttcagaatctagtgaacgaaggtttgtgtttatctttaattaggaagacattgataactcactttttagttgccttgcaaggacattaaagggatttttaatatatatacttactcctctctctgtaaactcattaaagaaagatgttacctttcttcctttcattctttctgttttttgtcttttgtcttactttctgttccttttataaacagtcattattatgtgttttccccaagagctcaggggtgggagcagtccccttagagaatattaatgaaatgttccatttggttaggggtgcttagtattaaaatcatccaagtcatttttttatgacaagtagtacaacttgtatattgaatcatcagcctaacatcaaaaattggtctttgtttaggaacacttttttttgagccttttttcttttctatttcaaattttctgttttcccctgcccacccctccccatactttggattcacctctttttttcatttctccccacccagtataattgcaggagggatgttttttctctgtatatatttgattagaggaattatgtggtagatttgcaactttctaaaaaagcatagatatgcatttggatgactcaagagtagtatttatactatagatttgtttgcagacttggtttctatagcctgcatatggcttttatatctgtatattataggacacgtgagaaaaaaagagaagacgggaaatggagagactatgaccggtactatgagcggaatgaattgtaccgtgagaagtatgactggagaagaggcaggagtaagagtcggagtaagagtcgaggcctgagtcgcagtagaagccgaagtagggggcgcagcaaagaccgggatccaaataggaatgttggtgagtagatgagtgtccccctaaaaactctgtagttatttatctgtctctatcacaggggtgcaagaaattctcttaaagttgtacctttaatatgtctgagcagtgtaaaaactggaattgtctcaagaagctcaatatccattttgttagaaaacagggctctattctggggatggagtcaagggagtttgattaaaaaggagctattcaagtgtatcattgtacatgtctagacttaactcattttgtataatggatacaaatatcctttaatcaataaagctatcacgtgaggaagagggttgcctgcttttcttctttgtttggttttctaaaagtaattgatttgctgtaagggtgcttgaagtttataaaattaaatggataaaataagtagattattgggatcccaaccactcatcttctgagatacaagtttggaagtcagttcttagataaccttcttattaaatatctgtggagaagctgactctttttcagttaagtgtaactgatgttgatactataaaagatgattttgcacaagttcttgcccaagatatgtcacttgttgatgtccctgcttttaggatatattaataaagagaggagtatgaaatatggatagctagataagtttaattcaacattctcatgttttctatgtgagaaaataaatatagtttaagaacatgaaatatctgatctctttgttttctgtttttaattttgtctccaagtagagcacagggaaagatcgaagtttaagagtgaaaggaatgacctggagagttcctatgtgcctgtgtctgcaccacctccaaactcttctgagcagtattcctctggggcacagtctattcccagcactgttactgtgatcgcacctgctcaccactctgaaaacacaactgagagttggtctaattactataacaatcatagctcttccaattcttttggtcgaaacctaccaccaaagaggcgatgcagagattatgatggtaaaaatcaccaccttttctcatattgtgcccaaaagtactagcagagcaaatgttgcatatattgcatatcttttagttatagtccagtttattttattttatcttattttatttattttgagacagagtcttgctctgtcacccaggatggagtgcagtggctcgatcttggctcgctgcaacctccatctcccgggttcaagcgattctccttcctcagcctcccaagtagcctcccaggtaggcaccaactcatggggaatgttgtttaatctacactcccactgacttctatggcctgtattatttcaagcaagtcacacacaggcatgtgccaccatgcctggctaacttttgtgtttttagtagagacagggtttcaccattttggtctggctggtctcgaactcctgacctcaggtgatctgcctgcctcggcctcccagtgtgctgggattataggtgtgagccaccgcaccatgcctatagtccaaattttgttaaaagggatgaatggggaggagaatctctgtttgatttaatggtttggctctcattaagagaatatttaaattttacccttttttagattttttttgtttttttgttttcactgttatttcaaacactgtatgccatagtatactgtaaaatttcatagacactagtaattgtaattttttaaaagaattttatttatttatttatttatttttggagacggacttgctctgtcccccaggctagtgtgcagtggcacaatctcggctcactgcagcctctgactcccaagttgaagcgattttcctgcctcagcctcccaagtagctgggattataggcgtgagccaccatgcccggctaatttttgtattagtagagacggggtttcaccatgttggtcaggcttgtctggaactcctgacctcaggtgatccaccttcctcagcctcccaaagtgctgggattacaggtgtgagccaccatgcccagccaggaattgtcatttttttgagtagtgtttgctgccgggaatttgtagaagttacttacaagtttgatttgctgactttccatttgaatgaatgaatcggtatgtgtgtatttcttttaaatttttattatggaagtatttatatattcataaaagctgacaaaatgatatgcttaaccccagtgtatccgttacatcatttaaataggcaccaacccatggggaatgttgttttaatgtatgctcccactcacttctgtggcctgtattatttcaagcaagtcacagacatcataatttttttctataaatacagaatgcatacgtttttacattttacttattttaaagtagggaatagagtcaaattataattcaagaattacctcattctcgccctaatctctcagccatagaatactccttgccaaggccaacgtaatgttatcaatttgttgtttatctttccaaacataatctgtgcgtatgtacataagtaaatacacatattttccccacatttttaacataaatactagtatgctactcatacttctgcataatgttttttcagttagcagtatttcctggcgttcatcctatgttaaaacatagagagctttctcagtatttatttaggcttcttagtattcttttttttctcttttttttttgagatggagtctcgctctgtcaccaggcaggagtgcagtgccatgatctcagctcactgcaacctctgcctcctgggttcaagtgattctcctgcttcagcctcctgagtagctgggactacaagcgcgtgccaccacgcccagctaatttttgtatttttagtagagacggggtttcaccatgttggtcaggatggtctcagtttcttgacctcgtgatctgtctgccttggcctcccaaagtgctgatattacaggcgtgagcgactgcgcccagccctgcttcttagtattctttatgtacaaacgtgtttaacttattccttattgatgtatgtttgggatgtttctattatttttctactatgtacagtgctacaagtgataacctggtacataatgttcacgtgaatatttgaaagtttcaacttccagatatagcaataatggttgctttagaataatgtaatgagaatagattgagagtaaataatctaggtcaatgcccttattctcccctaccccacgcctttgctaaattgatatttgtttaaaatatctgagtttttattatgaaagcttaattgcaaatggtttagtataatggtagttggtaacctgttcttgactcttttatttgctttctcaacaagtcatagtatcatagtgtaaaaagtagagagtacatctgcctctaccttggggatatgtgatgcttaacagagtaacactgagactttggattccttggagaaaaccactttgtaaatgagattggtgggtttttcagggacatgttttgttgttttctgaactctaagtagatgataataagattctttttttattctttattccacagaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagtaagtatatatttgttgaatttttctctagcgttctgtttagaagaacctcatcccttttagctaacttgacactcgtttaaagtgtttgagaaatagagtaataatataatttggaatatattcccataattaagatgctattcttttctttttttcatccgttattgcatgatgttatttgtattaccacagtgtaaattttgtgtgtagtggcctaacctatattgacctgcagtcaaatctagttatcatcttaagaaagccagtatttatttatttatctatttttatttagtttttctttagagacagggtctcattatgttggccaggttggtcttgaactcctggcctcaagcagtcctctcctgccttggcctcccaaagtgctaggattacaggcataagccaccatgcctggccaggaaagccagtttttaagatgtcagagaaaaaacatgttaggagttttatgaaattttccagtctttaaggaaaatctcttcaagaatattgaaataatattaaaaaaattttttttattacagacatttttagaagtagaatagtatgtgtgttgcaggtaccatcatccagcctcaatgacgatcaatattcagctgttttgtctcatattttcccttctctcccatacactttctttgggttggttggttttttgctggagtaaattctaaatgtcatgtcacttcaccagtatgtacttcagtatggatctcctttctgataaggactttttgtttttgttatttaaaaaaaaaaatcaatatgccattatcacatccagcaaaattaggagtaagaaatgttttaaaatggtcatttaaaaagcattattaacagttgccaatatagtagaaatagaagtaagactaaatttttaaaaagtaattgaaaaaattatggaatgaattgttttcatgtatgccaaaatataaaacgttatctgcttgaagacttttaacattaaaagatggcaaattaggctgggcatggtgggtcatatctgtaatcccagcactttgggaggccgaagtgggtggatcacttgaactctggagttcgagaccagcctgggcaagatggcgaaaccccatctctagaaaaaatacaaaaattagccaggcatggtggtgtgtacccatagttccagctacttgggatgctgaggtgggaggatggcttgagcctgggagacaggttgcagtgagccaagattgcaccactccattctagcctgggtgacagagccagaccctgtctcaaaaataaataaataaataaataaataaataaataaataaataaaagatggcaaatttttatttttagaaatattgctgttcagtttaagcagtagttttaatgaatttctttttaacattttattttgaaataattacagactcagttatagaattataattacggaaattgtgaaaatggtttcacatgatcctgagcttccctgcagtaataaagtattctgtagaatatacatttcatggcccggcacagtggtgcacgcctgtaattccaacactttgggaggctgaggctggcagatcacttgagctcatgagtttgagaccagcctgggcaacatggcaaaaccctgcctttacaaaaaatacaaaaattagccaggcatgtcggggggtgcatgtagtccctactgcttgggagcttggtgtgggaggattgcttgaacccaggaggtcaagggtgcagtgagctgtgatggcctcactgcactgcagcctgggtgacagagcaagactttgtctcaaaaaaattaaagaatatgttttattattaaagttggtaaatgtttggagggatttaatgcatatgtttggcctatagaaacatgttgttgtttttttttaacttagcatttgtgattttttttttcttttattttctttttgagacaagatctcactctgtgccctaggctggagtgcagtggggagatcttggctcacgactcactgcaacctccgcctcccaggcttgaagggatcctcccacctcagtctcctgagtagctgggactacaggcgtgtgccaccatgcctggctaaatttttttggacttttttgtagagacagggttcgccatgttgcccaggctggtcttgaactcctgggctcaagcagtttgcttgcctcagttcccaaagttcagggattacaggcgtgagccaccgtgcccagcccatatgtgaatatttaatataatcacataaacagtataattgtgaagctcaagctgagatttcatttcccagataaagcaacatcgttttatatatggaaattctaaaataaagaacgttatctcagcgtgggaacatatctatttaaaagttaaattcaagaataccatttctcccgacattttgctatgaaaagtttgtaacaaataggaaagttgaaggacttgtacttgtatacttaccatctaggttctacaattagcattttactgtatttatgttagcacatatctttccgtttctccatttttacttttgatgcttttcacagtatgttgcagacatcgtacacttaagcatgcttatcattaacttgaattctgtagaactttaccatcaccctagaaagtttcctgaagcctcttctcagccgttctccaccttcacccatagaggcaaccagtcctgccttttttcaccttagattagttttgcctcttctagaacaagtaatgttcttttaattgattatacaactcccagtgcttaagcttgcatatattaaattctttaattctattcagaaccaaattaggtattttaaatgtgagtatccaagttagtactagtatggtatttttttcttttttttaagatgaagtctttctctgttgcccaggttggagtgcagtggcgtgatttcggctcactgcagcctccacctcccatgttcaagtgattcttctgcctcagcttcccaaatagctgggattacaggagtgtgccaccacacccagcttatttttgtacttttagtagagatggggtttcaccacgttggccaagctgatctcgaacttttgacctcaggtgatctgcctcggcctcccaaagtgctgagattacaggcatgagccaccgtgcccggcctatgatggtccttttttttttttttttttttttttcgagacagagttttgcttttgttgcccaggctggagtgcaatggtgcgatctcggctcaccgcaacctccgcgtcccaggttcaagcgattctcctgcctcagcctcctgagtagctgggattacaggcatgtgccaccacgccctgctcatttttgtattgttagtagagacgaggtttctccatgttggtcaggctggtctcgaactcctgacctcaggtgatccgcctgtcttggcctcccacagttctggattacaggtgtgagccactgctcctggcctgatacttttattaggaaatattaatgctgtacttttcactttttgttgtctgtatgtaggaccacctataacacaatcaagcttgataaacagccgtgaccagcctgggacaagtgcagtgcccaatcttgcatcagtgggaacaagactacctcctcctttaccccagaacctcctttacacagtatcagaacgtaagtacatgttgtttgacttaaaattgacagggtatagaaaagccaagttgtctcatatcagtataaccctttaaaaaatggtaaatagtttctgttcttatggattctaaaaattgtatttgtgtttacaatacagtttatcgtgtgtttctgctatatagccacattttaattttgtgtgatatgggagagaaaggcaaggctttctgttttggagaattttactctgccatggagtagcaacatttagtctctcctttttatttttttgagacagagtctcgctctgtcacccaggctggagtgcagtggcacaatctcagctcactgcaacctctgctttccaggttcaagtgattctcttgcctcagcctcccaagtagctgggacagcaggcgtgtgccaccatgcccagctaatttttgtatttttagtagagacggggtttcaccatgttggccaggctggtctcgaactcctgacctcaggtgatctacctgcctcggcctcccaaaatgctgggattataggtgtgaaccactgtgcccagcctaacgtcaagtctcttctaaaggaaatttattttgaagctttttaaaaaaattgtttatctgattgattttctaaagcataagatgtatctcctaagaagtatacaaaagagcgggttaattatgcctaataattaacttgcatactgaaataaaggtagagcatcatttaaattgtaattttctgtatttaggctgtttgtgacattcacatttgattgtaataatacatttttcttgggccaggcgcggtggctcatgcctgtaatcctagcactttgggaggcctgggtgggcagatcatctgaggtcgggagttcgagaccatcctgaccaacatggagaaaacccgtctctactaaaaatgcaaaattagctgggcgttgtggagcatgcctgtagtcccagcaactcgggaggctgaggcaggagaatcacttgaacctgggaggcggaggttgcagtgagccgagatcgtgccactgcactcccgcctgggtgacagagcaaaactccgtctcagaaaacaaaaaacaaaatgatttttctggaatcctaattctcttttgtttcttaggtgttttattgtttactaaagctttaaaaaattacttccttcaaaaacattttttaaaaaggtagttggttgttaaaaatgtcaaattagaagatttttttttttttttttacaaggcctggtaactttatggatatgttcctcttttatgtaactatgtatatcataaagtttattttgcatcctaaacatttctgtatctctttgatgtcttggagaggcaattcagcaaactcgttaagcccagtttcaaatcctggttttatcatttactatctttgtgaccttgagtaagttgcttagtctctctgtagctcaatttcctcttctttaaaatgagaataatattacctcattaaggttgttttgagtaataaattaatacatctaaagcatctaaaaaagtgcctagccactagtaagctataaggattcattattatattattgtagttattattgtctcctgaaatttcaaactctgaaattgaacctattaacttcttaaatctgtaccttctaccatccctgtttttgtcaatggagtaacacccacctaatacctagaattgaaaccttcacaggactgactcattgctttgcttttttacatctggttaatcaaaaattctttttctttgaagtagccctttctatttcttctgtggcctctgccctcatccacgctagatcacttcacatttggattattactgcagcctacttgacaccattatgttttatgtttaacttccctaagtcataccacataatgctgctaagctaattttcctgagaaatccaaccatgaaagttccttatgagaacttttcggtggctaccatttctttctgagccatcagtaaacccctctctaggacttctaactcctttttttttttccttttctttttttttttttttttttttttgagacaaagtcttgctctgtcacccaggctggagtacagtggtgcaatctcaactccctgcaacctttgcctcccgggttcaagcaattcttgtgcctcagcctcccaagtagctgggattacaggcatgtatcactatacccagctaatctttttgtattttgggtagagatggggttttgttatgttggctagctgtcaaactcctggccttaagtgatctggctgctttggccttgcaaagcgctgggattacaggtgtgagccaccacgcctggactttttttttttttttttttgagacagagtctcaactctgttccccaggctgaagtgtggtggtgccatcttggctcactgcagccttgatcttccaggctaagtgatcctcccacctcagcctcccaaatagctggggccacaggcatgtgccaccacacccggctaatttttgaaatttttttgtagagacggagtctcactatgttgctcaggctggtctcaaatttctgggctcaagtttctcccacctgagcgtcccaaagggttgggattacaggcgtgagccactgttcctggcctttaactctttcaatagtctacctcttccttcttggcaatctttgtccactattcctcaacatgcatcttctctggtaatgccaattataccctttctgtgcccccgtcatggctcaactttcccccccaatcttctttcctactaatatactctgtcttcacctctttctaggcccaaattctaagtatacttggaagacatgattgctgttttctatctgtctgtctgtctgtctgtctgtctgtctgtctgtctatctgtctgtctatctagagtctcactttgtcgcccaggctggagtgcagtggtgagatctcagcttattgcaacctctgcctcccgggttcaagtgattcttgtgcctcagcttcccaagtagctgggattacagtcgcccaccaccacacctggctaatttttgtatttttagtagagatggggttttgccatgttggctaggctggtctcgaactcctgacctcaggtgatccgcctgccttggcctctcagagtgctgggattacgggcatgaacccctgtgcccggccttttgctctgttttaaactcttacaataccaaaaagcatttgttacataatgacatatacttatatataggcctactgtttgattttttttaatatatgtaaatcttacattcaactgagcttctacagaacggaaatcacatttgatacttaagtaattgtttttcctgtttcatacttagtatctcgctgtattctgattgctatagcgtcttttcatagaacatgtttgttgctcattttttaattatgggaaatctcaaatatatataaaagtaaagaggacagtatatggaactccggagtacccagtataatgaagttctttgtgcttatccctcagtttcaacctttatcaatttatagcggagcctcttttatctatttccccccgaatcagctcttaatattgtttgccttttggacttgtaaatatgaaaaagtggactattccagagtgtgttgcagatggcatatttttatactgttaaatttggtattatgactcatgataaaaattccatcttgtttttaatttaaaaaaaatctggcaattaccatttatttttatattgttaaatttaacattgtgactcactctataaatattccatttggttttaatttttaaaactctggcagttaccatttatttcagtgacttagcttaataaataaattaatttggcaaatatttattgaatgcctactatgtgccaggcatcgtgccagacactagggagccaaggtgaataagatattagatctcatgttttttgaagtccatttttctgttttatttaaaagtaagactattttgtagtatatgagtaaaggccttttagaactgtatttccaaattattattattttttgagacagtcttactctgttgcccaggctagagtgcagtggcgcaacctccacctcccaggtttaagcttgtgcctcagcctcaagtagctgggactacagtcgtgggccccaaggcccacctaatttttgtatttttggtacagatggggtttcgccatgctggccaggcaggtctcaaactcttggcctcaagttatccgcccgcctcggcttcccaaagtgctgggattacaagtgtgagccactgtgaccggcctctaaactcattttttaaagactggtaacgtttctaagaaaattcttgggacctgtacagttagcagcttgttattttgccaggttaaggtctgtatatgaaaatatctaatactttaattttaaaaatatgtttttaaactgaagaaaggacataatctcagaataaaagataatctttttaaaaatttatttaaaagttttaaaatttttagtaggcacaggttcttgctttgttgcccaggctggtctcaaactgtgggctcaagtgttactcctgcctcagcttcccgaagtgctgggatcacgggtgtgagccatcacacacggcctcaaggacaatcttttaattaaaaaaaaaatcttttgtatgtagaggcagggtcttgctgtcttacccaggctgggtgctcaagcagttgtgccttggcctcccaaagtgggtaggattgtaggcatgagccaccatgcctgacttaatcttttaatatttgattttatgaaatagcactacatatcccccccgttttgttgtagaccaataaaaggtgataatttccccttagcatttgtgaattactgctttagaggattgtcttatatgctgcatcagtgttgataaacagatttgattggttggcaactgaatattttgaaagttatagaatattcatattgaacacttcagaagtctgctatgcagagaaatatgtggttttctttcttgagtgtgaaatctgattctaaaatttatagagaaattttgaagactagtagagttcctgataatctaaacattaaaaaggggatgtgtagtatagtttgtcagtcataagtttatttatttatttttttagacggagtcttactctgttgcccaggctggagtgcagtggtgcgatctcagctcactgcaacctccgcctcttggtttcaatcgattcttctgccggagcttccccagtagctgggattacaggcacatgccaccaagcccggctaatttttttttgtatttttagtaaagacagggtttcaccatgttggccaggctggtcccaaactcccgacctcaggtgatccttccgactcagcctcccaaagtgctgtgattacaggtgtgagccaccactcctggcctcagtttttaatatctttctattacctttatatttctaataagtttttaatatttttctattcagttgattttaagatagcttttgggctgggcatggtggctcatgcctgtaatcccagcactttgagaggctaaggcaggcggatcacctgaggtcaggagtttgagaccagcgtggtcaacatggtgaaatcgcatctctactaaaaatacaaaaattagctgggtgtggtggtgggcgcctgtaatcccagctactcaggaggctgaggccagagaatcacttgagcctgggaggcagaggttgcagtgagctgagattgcgccattgcactctagcctgggcaacaagagcgaaacgccatctcaaaaaaataaataaaataaagtaaaataaaatagttttaaaaatatttttgtctttgagacagataattgaatccttcacattgttcaagtttatttttctaaatacaggtcaagcattcccagtctgaaatgctccaaaattagaaactttttgagtgccaatatgatgctcaaaggaattacttactcattgaagcattttggattttggattttaagatctgtgatgttcagccagtaactataattcagagatagaaaaatctgaaaaagtctgaaatctgaaacagttctggtctcaagccttttggatatgggatactcaactcgtactataattggtaatttcaaaaagattagaagtttgattcaaataaagtaaaaagctatatgtatgttttcagtgtgtaatgagaacttgagctgtcttaaaagtttaacaagttgggaaagtttaaattatggatattttattgtcattaaaattaatattaaaattcacagcacagaaaatataggtgaaaaatgcatatcaaatggtgtttagttgtgcagatgatgtcaataaggacccaaagtaaacacagaaaaacgaaatctggatttttcaaggtaggagttggagtctgctcagtgttaggtactaggaatatacagatgaataagaaatggtcatctaagaatctaaaaatctaatagtgggaaagaaatatgttaaaaaaaatctccacaaaatgaaaacccattacagtatattttgctattacagctaaaaaaaaaccccaggtaacaaaggaactaattctgtgagaaataaagcattcatttaggctgcagttgtcactggttttggaaaaagacaagttggatgttaaaataagaaaaagaattaacctgattctgaaactgaataggatatacatggttcctggtaaagttaatattggctgaatgcagtggtttacccctgtaatcccagcacattcaaaggccaaggttgggaggattgcttgagcccaggagttcaaggctgcagatagtaccattatactctagcctggacagcagagagaagtaagaccctgtcttaaaaaaaaattgattataatttataaaaaactttgaaattttgttacttttcttgagttaaaatgtcatagaccctgtgaaaataaataactaactgtgtttggaattttgtgtaaagacagcaatcaactgttaaaatcaactatttcctctgaagtacttaacattttacccatgcccccccaccccctttatttctttttgagacagagtcttgttgtgctgcccagactggagtatggtggcatcatgggtcactgcagcctcaacctttcaggctctggaaatcctcctacctcagcctcctgagtagtttgggaccacaggcatgcaccaccatgcccagctaattttttaaattatttataaagatgaggtctttctgtattgccgaggctgatcttgacctcctgggcttgagctcttccctgaaccttagtcccccaaagtgctgggattacaggcatgagccaccatgcccagcttaccccaattttaaaaacatttatttatttatttatttaccttttttttagaaatagggtcttgctctgttgcccagggtggagtgtagtggcatgattctagctcgctgcagccttgaaccactgggcttaagtggtcaccccaccacagcctcccaaataactaggctgtacaggcacatgccaccatgcccagctaatgttgaatttttttgtagtcttgctgtgttgcctaggatggtctcaaactcttggcctggagcaatcctctcaccttggcctaccagaatgctgggattacagacctgaggcattgtatttggacccctaattttttttttttttgcatgggggtttcttgttgggagaccagagaacttgctagagaaaatcttaaagagctgtaccactgcagcctccaagtttgaactcaccaactcagtatatacttttggcttttacaagaccattattaagtaaagtacactctcttttctaccttgcttttggtctgttctgcttcttgaagaagcatagtaaaaatattttgtaactgctaagttcgttcgttgtactggatgtgtgaaaaagtaagagtagcaggtaacatcctggattctagagactgattcttaggttgaagataactgtccagtcttaatataaattcacataaatctttatctttcagaaaatactttcctactaactgtataaaattgttaaaacagtataattctaaatttgagatttgctcatttaattctgtggcattatgtagaataatgggtttgatggctagaaaagtaagtcagtgtctattagagtccttgtatattgtctagagcaggggtccccaaaccccgggtcacggtggcactaaattatcataggagactcaacggtattgtaaattgcgcatatgaaggatctgagttgcgcattctttatgagaatctaatgcctgataatctgaagtggaacagtttcatcctaaagtcaccacctccactcacccctgccatttgtggaaaaattgtattctgtggaaccggtccctagtgtcaaaaagcttggggactgctggtctagaggctttctcccccttgtatttgacctgattcatgttgtattagttgtgacattgtctatttcaacatacagatattcatccaaagaagtacttaagtttcatttgggtactttaagctttcattttttctttaagtgactgtttgatttctattatacatcaggcactgtttagcccttggaacttctcaagtgtaccaggtaccttgtattctaatcaagaagacacataaatatggccagtattgggaagatgtagctttttattttttctggatttgagtttttagcttaaaacttaaaatttttttcctgtgaatactcttaaagacaaaatcaggaaaattatacagagttgctaaaattttaggttgaataaagactgtctttattctgactagagttaatattaagaagttgaaaatattgatattaggcatgttacctatatgaacaatttaagatgggaacatgaacttgggatgtttgcagtttggaaactactctgaccaaaactaaactgaatgaatataaattctgacagactgatcttcaccattactgtaacctatttgatagtgaacattttttaatgtagctgggcgtgtgggcatgtgactgtagtcccagcctcttgggaggctgaggcaggggaagataccttgaggccaagagttccagctgcagtgagctatgatcacacctatgaatagccactgtactttagcctggataacatagtaagacctcatctcaaatttaaaagagaaaacatattatgatggaaaatttcaaatacaacatacataaaagtagactgtgtaatgtagtgaatcttcatgtacttatttctggcttcaacagttaatcaatgtggttaatcttgcttcatccataacctactcctgacttgattattttagtgctgtggttttttttttttttttttagacaaggtcttgctctgtcacccagccttgagtacagtggcacaatcttggctcactgcagtcttgacctcctgggctcaagcaggcctcctgtctcagcctcatgagtagctgggagcacagatgcgtgccaccatacctggctgatttttaaattttttgtagagatgagggctccccatgttgcccaggctggtctcaaactcctgggctcaagcagtcctccagcctcagcctctcaaagtgctgggattacagatgtgagccatcacacctggccttagtttttatttttgttttcttttttattgctcctcaaaattcagcttaatgacatgattgttttagaataagtcccaaatatagtagcatttcatctgtaaaaacttatgtatctttgaagataagaattaaacatacatacacacaaaatcctacatacacacagtactattatcacagtcccccccaaaatttgtaacagtttactattccttgtgaaatatccagttagttttcatatttctcaattgtatcataaatgcccttttgtacctggtttatttgacgctatatccaaacagggttatacattacgtttagttgatatctttcttaagtctttatagaaatatcctttacttctttttttttctcccttggcgtttatttgttgaagaaatagatcatttgtcctaaagaattttctcacattctagacttggcagattgatcttctggtgtcatctaacacattcctctatcccctgtattacctgtaaatttgaagttagagctaggtatttgataaaattcaatttttttctttttttggcaagaacattttatagatggcgttatgtacttcctacacagtacattataatgctcatgatgtctggttgtctcctttctgtgttataaatattgattagtgtgtaaaggtgttttcatcctgatccattcattttaaaacttgcttgatggtttcaacagccatttttgatcattgcctggatttgctgttgtatgtgaaactctaaatctatagtttcttctacatttattgctagcattccatatagttgactataacaaccatttggttaacctgaaatgcagtttttacagaagagacatgatatatgtgtattttctttcatttatcaattttaagaatgagttgattccctagttttttccaaagggaactcctgttttttttttaagtatcattatgaactcatgaatttttaacatttgatatgtttcactccattatagtcttttttgatgttcagattgtctcatctttaatcaataggagcctcttcatgttggcttctgctagtttttttttttttttttaatttttgacatgccagtttttgataactctcttgcttctggaaggacaaggtatactaaggtgtaccaggctcatcttataaattttctgccctgacctagaattagccctttgtctaaagaactctgttgctttagaagtagtatttagagactcagtaggaattgtttaagaaagtcaggctacatttggattaattgccatctttttgaggtatttgttttttattttgaggcagaggctttctctgttacccaggctggagtgcagtggtgcagtctcggctcattgcaacctctgcctcctgggttcaagtgattcttgtgcctcagcctccagagtagctgagattacagacatgcaccactacgcctggctaatttttgtaattttagtagagacggggtttcaccctattgcccagcctggtctcaaattcctgagctcaagggatccacccgccttggcctcccaaagtgctgtaatcacaggtgtgagccatcgtgctcggcctttctgtatgttctttgtcagtagttttaaaaacagacattgggcaaagtagccttttggtttccagtttactttgagacagctattattaattagacatacttaattagatagtatacttagtacatcaagtgatgtatcatacatttaaagtagtcatatggactaagattgtacttcccatttttctatatatgtatgtatttctattttttaattaattttttttcttttaaagacagcatctcaccctgtcacctaagctggagtacagtggcacaatcgtggctcactgcagctttgaccttctggctcaagtgatcctcctgccctagccttccaaatagctaggactacagctgtgcgccaccatgcatggctaatttttaaaatatttagtagagacagagtctcggtatgttactcaggctggtctcaaactcctgagctcaagtaatcctcacaccttggcctcccaaattgttgggtttatggatgtgagctactgcacctggccccatttttctctttaacatactactacattctgctgataggtcactcttcacaagtaattccctgccattgattgtgtgcttacaactatttgttcccctcattgagactatgttaaattgggctgggcacggtggctcacgcctgtaattccagaagtttgggaggccgaggtgggtggatcacctgaggtcaggagtttgagaccagcctgggcaacatggtgaaaccccgtccctactaaaaatgcaaaaaattagctgggcgtggtggtgggcaccagaaatcccagctactagggaggctgaggcaggagaattgcttgaacctgggaggcagaggtcgccgtgagcccagatcatgctactgcagctccagcctgggcgacagagtgagactctcaaaaaaaaaaaaaaaaaagaaaaagtaaaaaaaaaagaaaaaaagaaaatatgttatattgtttttgcagtgtaataattagctgattctttttaaatgtacttttttttccccatcaacttttattttaagttccagggtacatatgtaggatgtacaggttttttacgtaggtaaatgtgtgccatggtggtttgctgcacagatcaacctaccacctaggtattaagcccaacatccattagaaatgtaaattttaaaagggttaatgctaagtgcacagttatacagtatgatttgttacttcctcttttgcttcttatatacgaagaaaagggtagtgaagtttagcatctccatattccctttagggacttactgtgaaaccaagtggttgctttgtagcctgtcctattaaggtgcatttaaaatctttaggaattttacagcttttaaggacatttcaccaggtataaaaaaaattcaaggctgggcgctgggtccggtggcactttgggaggccgagacgggcagatcacgaggtcaggggattgagaccatcctggctaacacggtgaaaccccgtctctactaaaaatacaaaaaaattagccaggcatggtggtgggcgcctgtagtcccagctactcgggaggctgaggcaggagaatggcgtgaacccgggagacggagcttgcagtgagcaccactgcactccagcctgggtgacagagcaagactccgtctcaaaaaaaaaaaaaaaaaatccactttattttgtcttgtgtcacatagtaaatgtctgatgttggacatatataataactaaatcatataaatatgtctcaaatggggttgtcggtgaaaaagatactgttaaatggacacccaaagggattttgctccttgataccttatctttttctaatcctgtccttcagattttggcttcattgtgtgtgcattcttgcattagcctatatataaatcctaaatgtgttgtctttcaaaaagtgcttcttaatatccaggataatttcatgtgtccagtgctgtgctggtctgtttatctgttttttttttgtccttttttttttttttttttttttttgagacagagtcttactctgtcgcctaggttggagtgcagtggcacgatcttggctcactgcaacctccacctcccgggttcaagcagttctcctgcctcagcctccctagtagttgggattacaggtgcccaccacgacgcccagctaatttttgtatttttagtagagacggggtttcatcatcttggccaggctggtcttgaactcctgacctcatgatccacccacctcggcctcccaaagtgctgggattacaggcgtgagccacgtgagccaccgtgcctggcctgtccttttccctttctcaatttttgttatccatgtgctcacagagataacaaattttcactatctttaatttttttctttggagcattttttattctttgcgaaggtatgcatatagtggtttgttttttcttaatgtctttgtctttttttctgctctcagatacgggagcatatttggtgcaaacctgaaattatgtgggttggttggagaggggttgttttctttttaatggatatgacagttttcatacctgcatatctcattggatagaaaaattctgtgtaattaatagctcagggctcctttgtctaataacctgatatggttcactgttcagctttagataaaattagcacgtagttttctccacttaagatcataaaagatggagattatatatactacttaattcttattcttttctttatacctcaatggatcctaaccagttgcacgtctgttctttcttgagttagaaagaatcccaggaacatctttctgtacttctattcctgttggtttaatttctctgtttttggctcaaagtctcaggaaacacatcatcacctaagagaagcttgtgactctcattcccagctgccctcctattctttcctctataggacagcccatgtactctcgtgaacatggtgctgctgcatctgagcgacttcagttggggacaccgcctcctctgttggcagctcgtttggtgccacctcgaaacctcatgggatcctccattggataccatacctcagtctccagccctacccctctggttccaggtaagctttgctacagatggccatccacctcactgatcttttttacctcaagctggccagtctaagcggtgacctggcatcctgatctgctgttacaaagtcccattaaagctcataggtagttttattttctgctcctttgcttctttggtttgtctctagtggctgctagatgattaggcctcctgtgtatctgtcatctctggtgtcctctatatttactttcagtgcctcggtaacaaagtgatgctagttccttgagctagtttctaatcaggtagatagaaagataatatctacttgaatgttttctaattagttatacactgtaataaactaggttaatttttctttaaaacaaaacaaaaataaacatctggtttcttgccgatcatatcctttttccccttttgccccttgtatgtgtgcataatgtagcgattcttaaaaactcttttctcctattgacatacgtattttgaaggatctgtggaatgctttgtgggtgtttcatgaggtgtttttaaccctttctcactttgcctttggatcttattcttataattaactaaagggcttttaagttaattggtgttctgtgtattcccaggatttatggcacaaggtcatttgattatgtaacttctttaaaactttctgcagtcttaactgtaggagattttctgtcagtagtgccaagtggtaactgaaaactttttaatcataatttgctaatccttttttaaaaagataaagcagtatgcattttgtatgttatattgcatgtaatttttagagttggcataagcagggaagctgttactttacatatcattttcaaactgtgtcatccttaaacacattgaaatttaataagcaactatgttagatttacttttaagctagacatatcattacagtgtgtttccatcaggagggaatgctcatgattaaatactgtctttagttgtcttaaagagacaaaaaatttataaagagaggagttagaacaaaagctaaaataattaagtatgaagcccccaaaatactctttggcggataactataatcatagtcctgtaaccattgaggcaaaattatttgtttttatttatttatttatttatttttgagacagtctctcgctctgctgcctaggctggagtgcttggagtgcaatggggtgatcttggctcactgcaacctccacctccagggtccaagcgattctcctgcctcagcctcctgagtagctgggattacaggcgtgcatcaccaagcccggctaatttttgtatttttagtagagacggggttttgccatgttggtcaggctggtctcgaactcctgacctcgtgatctgcccaccttggcctcccaaagtgctggaattacaggcgtgagccactgcgcccggcccaattatttggttttattgatcatcatcaggaaactttgagactgaatgcaagccttaggaatgaaataaaaaatctctaataggaatgtcattgtgataataatttattaaaatttctgtgccattgttctctgaggaggacagtacagatgccccaaatgattaattttcaacatcatttaacattttattagagggagacagttcttaatctagtgatgccttttttgtgtgtaattccatgagctgttttcaaaacctgaaaaaaggggaaaaatgggggtgggaggaagagaaggaatgccaaccagcagttctagttcttatattagatatctcagaatcacctgtgctttaatggcattttattattattgcctcattatagcttctggatgttttgtgcaagaaggaaattagcttgtgaatctgaagttaggaggagcacaatattcgtgggagaggtttaatctaagagtattgggggtgagacgttttctggattgaggacttctgaatcctagttgtgctgcttattggccgttgactcaaatgcctgtagtggccaggaagatcccctaaatgaggataatttgctgatcttatattctgaatcacttctatactgtaaatcatagaagtgactgacgtgtatgtgcgcgtgtgtgcttttttatttgaaatatggtttatgtgtgaaaccagctgttctcactctagtttgaagaagtgtacataaccaaatgaatacattttcttttcacctcaattaaaaaggtacctagaaattggagatatgatggataacagaggaaactcaattcttcacatatggtgtttgtgtatgtgaaaatttgtattaacaaatgtgcattgggctgggcacagtgactcacacctgtaatgccaacagtttgggagactgaggtgggcaggtggctgaagcccaggagttcaagaccagcctgggcaagatagtgagactccatctccgtttttttaaaattagaaaaaaaagtgcattgacatttggattaggtaattaatatatagagtagaaatgagtaggtgagtgaatctgaaagtatcagtatttaagaatggatgcatatatctatattctgtaataggagcatttttttttttttcagtttcaaaaggtgtgtctagatactgtaacacaaagagaaatacagtcatcccttcacctcaggttccacatctgcagattcaaccaactacagatcaaaaatattcaggaaaaaaataaaaataaaaaaaaaccagtacaataattaaaaggaatgcaagttttaaaaacaatatccataacagctatttacgtagcatttatattatgtattataattaacctagagatgttttagagtatacaagaggatttacctaggttatatgcaaataccaccaccctgttttatatcaaagtcttgaacatttgtgcatttttatatctgcgggagggtcctggaaccagtccctcacagatactgagaggtgactgtaggttgatgtatttgttggagaatatatgttttttaagcagttgtttattttataacaatgagagatggtttaacctctctctgatttgttgtgtgttttgttgctttgttttccctcagatacatatgaaccagatggttacaacccagaagctcctagtattactagttctggtagatctcagtacagacagttcttttcaagaactcagacacagcgtcccaatctgattggcctaacatctggagatatggatgtaaatccaagaggtgagaataccttgaactttttctgatgctaagtgttatgcagtagttggatatagttattacatttgcatttctggcctagcttgaggaaattaaggtccaaattacttatatattatctctttggagggtgctatgtattaatctcagattttttaaataactttatctccaaattttattttaaagctatagttaggctatatttgtttttaaatgcaaatcatactaatattatttaactgcttcttttggtaggactttaggctgttttagttttgttgctaggcactgtgttagatattgtgtatagaaagatgaaattactgatcccctgccctcaaagaactgatcattgaaggacctgctttgtatcctaagagctatgcatcacactaattatattgagaatctaaaatgttacaattatttgataatttttaacacttataattacatctttaagttaggacctttacaaaacttaggaataaaccttaaaaatgaaacaaaaccaagattaaatgcaagcatttacctttaatatggctgataacctcctacctactcccccactaaaaaggttggttaatgatggttagtttgatgagattccagtttttttctagctattatgaatttccaatatataatttcaacatgagtgactggccatggactgcactgacacaatagttttttgattaatttaatcatctggcaaacattttccttttcttcctttcttttcctttttttcttcttcttcttttttttttttgaaatggagtctgggtctgttgcccaggttggagtgcagtggcgtgatcctgactcactgcaacctctgcctcccaagttcaagggattctcctgcctctgcctcctgaatagctgagattataagcatgtgccaccatgcctggctaatttttgtatttttagtatagacggggtttcaccatgttggccaggctggtcttgaactcctgacctgaggttatccacctaccttggcctctcaaagtgctggtattacaggtgtgagccaccatgcccagcctagcattttcctgttcttcctttctatcctagctttattaattcttttttcctgctgttaataacactattaccactataagaataacaggttttgtatgaagactacaccaaatgccttctcatatatatatattttatatatatattatttatatatatatttttatatatattatttttatatatattatttatatatatatattttttgagacagggtctccttctgtcacctatgctggaatgcagtggcacgatctcggctcactgcaacctccgcctcctgggttcaagcgattctcccacctcagcctcctgagtagctgggattacaggtgtgcaccaccacaaccctgctaatttttgtatttttagtagagacgaggtttcaccatattggtcaggctggtcttgaactcctgacctcaggtgatccagatctcacctcggactcccaaagtgctggtattacaggcatgagccactgcacccagcctcatatatattattgtctctcatatttctatttttattctccttttacaagtaaaaacactgaggcttagagaggtttaaagaacttgcccaaagtcacacagctgttaagtggcagaactagaattcagaggagaagtcatgttgtgtatacaacaagatttctttgttgtcttgggtaagtcacttaacctttagtgacttccttcctttaatatgacacacttcattaaattaaaaaaaattaattaaaaaaaagcattaggcaatgttagctggtaatgataaaaactatttaaggagaacataatggcatctcaaactctagaatgctttatgccatcgcagttgctatcttcttcattagccttctgcaaacacaagtcccgcaagagcaaggatcacgtctattttattcactaatgtatacccaaggtctgctatagttgctgagctgtaaaatagctaaacgttaagtgaatgaatctttacatcataatttccctgacaaagatgaaatcaaatgtaccaactcctaaccatatacctaccccagcattcagctctgagttattctttgcttggtggagttgctaaagttaagagaaatactcaagatttaataggcatagttttgtgttgctaatttctgttttgttcagtacacgtcttcctacccacaggttatttattgtaaggacagattcttagagtatttctgccaatttatagtattggctttggattttcttcccaactttaaacctgtggaaaatcaaaagaaacacagtgaacatttgaatgccttcatttagattcaccagtaatattttactacctttgggcatgaatgctctcttgtatactctctcttctctttcttctctccactcacatttttttgttgaatctcttgaaattaattggtagacattgtgaaactttaagtcctttaccttatatctaagaataagacagtcctatataagcacagtattattgccacacataaaaccataattccataataatatgtaatccttatgatttggtgaacttcttgttgaatcataccaggaggcaaataatgtccattaatggtgctaagtttgattgcttgtataaggtgatcattgttggagctctccattgtttttgttttttttttttggtttctttatgagaccgaatttcactcttgttgcccaggctggagtgcaatggcacaatctcggctcaccacaacctccgtctcctgggttcaagcgattctcctgcctcagcctcccgagtagctgggattacaggcatgcaccaccatgtctggctaatttttttgtatttttagtagagatggggtttccccatgttggtcaggctggtctcgaactcccgacctcaggtgatccgcccgcctcggcctcccaaagtgctggaattacaggcgtgagccaccgtgcctggcccagagctctccattgtaaatgtaatttttggagtggtactttggcaccataaatatcttgttttccagcaacctttcaccaatatttttttcatctattgatcatccatgcctgagtcaattattacatcgaggttaactttgagttttgaaacatggatttctattttttatagaaaaaggcatttgtaactttttcttctgttaggcatttctaaaagagaaatgatagtagttgagctattcatagtagtttttagcttttagactaaatatattaatcattgagactcctgaaaaactcagtaatttcaatttttttttccaacagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagtaagataatttgctaattagtagcatctaattgttattgtcgtttgcattggtaaattcataaaaataagatttgtcattaattaatgtttttcaaactaggtatcttgaagttagggttccaggagacatctttagaatgttgtaaaaattaaaaagttaacaatatttataattttttttttttttttaaaagacgtagtcatccaggctggagtgcaatggtataatctcagctcacctcaacctctgcctcctgggttgaagtgattctcttgtcccagcctcctgagtagttgagattacaggtgccagccaccatgcccacctgattttcttgtatttttagcggagatggggtttcaccttgttagtcaggctggtctcaaactcctgacctcaggtgatccacccaccttggcctcccaaggtgctgggattacaggtgtgagctaccacatccagcccaaaataggtatttctaattcgtacctacctatttctacgcctaacccaatattagaaattactgagacactagcaatggatagaaaagaagaaaaaaatgaaatcaacggtgaaaaaaaaaagcttagtacctttgcagaagttgaaaatatgccgttaaagatgatgttctagctgggcacagtggctcacgcctataatcccagctctttgggaggccaaggcgggtggatcacttgaggtcaggagttcgagaccagcctgaccaaaatggagaaagccaaaatacaaaattagccaggtgtggtggcacgcgcctgtaatcccagcaacttgggaggctgaggcaggagaatcgctggaacctgggaggcggaggttgcagtgagttgagattgcaccattgcactccagtctgggcaaaaagaacaaaactctgtctcaaaaaaaaaaaaaaaaaaaaaaaggtggtgttctagccttcatttaatgatgttagagtctttgataattgtggtagatctttatggtagatctatttagcatatgattttaagtgttagttgggccttttctttttgtaatctattgctgttcaccttttctattctcatgtaataagaataatgtggccgggcgcggtggctcacgcctgtaatcccagcactttgggaggccaaggcgggtggatcatgaggtcaggagatcgagaccatcctggctaacaaggtgaaaccccgtgtctactaaaaatacaaaaaattagccgggcgcagtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaaaaagaataatgttggccgggcgtagtggctcacacctgtaatgccagcactttgggaggccgagacgggtagatcaccgacgccaggagttcaagaccagcctggccaacatggtgaaaccttgtctgtactaagcatacaaaaattagtcgtgcgtgttggcatgcacctgtaatcccagatactcaggaagctgaggcaggagaatcacttgaacttgggaggtggaggttgcagtgggccgagattgttccacggcactccagcctgggcgaatgagtgagactccgtctacaaaaaaaaaaaagaagaatgtgaaaattgcttagtaatttccgaagaatgttaagggctcacaaaaggaactttaaacaaattaatcaatcagttaatttattacatagagatgtggtcttactatgttccccagactggtctggaacccctgggctcaagcaatcctcctgctttggcctctcagagtgctggcgttacaggcatgagctacttcgctcagcctgtaatctgtttctggatgcttatgtattttctgtggtttgaattttgaatataatgtttcatatgattttgaagaagttttctgggattataggtggagccaccatgcccagccacaaaaggcacttaaaaaaattataaacctaaattctttgtggttatatctctttgctaggcatgaagtaggagaattaaccaagatgtattaatcttccttttaggcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggtaaatgtggctatgtcagtgacagaatccaggcattttatgggtcttgggaatatttctatcagctcaccttgtttaaatgagtcagtggttattctgatcatctctgctaagtgctgtaaatgccaccatatatctatatacccacttttatgatggacttgttaaaccatgtttgttcttgtgaattcatttggttcttttctgcaatctcttcctgaaagagaatgggtagcctcacagttttggagactgagaagtccaagatcaaggtgctggatgattcatttcctagggagtgctgtcttcctcgcttgcagatggttggcttcttgtgttctcacatggcagacagagaaagagaaagagggggtcagggcagatctctttctcttcttttaaggccaccgatactattcattaggatgcacctttgtgacctcatttaaccttaattacatcctaaaagctctatctctaaaacagtaatgttggagtttagggctttaacatgtgtattttggggaaaacattcattacatagcagtgggtcataatttatttaactattttctgtttttgggaatttatattgttttattttcttcaaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaaggtaatctggttcactgggaattaaaggtcttttagttacaccctctagatcagtatttttcaattcctggtccttgggtcttctacagaagagctactcttaatttgaactgcagaccagtagcatctgatctcctgggatcttatagaaatgcagattcttgggggaaaaatttcagattcttgagccatactccatcctactgaatcagaatccctatgggtggggcccaaggatttgtgttttaacaagctctcctggtgattcttacataccttaaagtttgagacctgctattttacatcagaatcacttacctgggtgcaaatttctgggcttcagcttctcaaacctctgtagagtcagtctctagatacagggcctataaatatacatatttaacaagtactcttaagttattgttatgcaccctaaagtataataaccatctaccacagagcaactttaactgtagagctatttattttttagaatcagtcttttttgtgtctacccatttgccctcctttttcccatgtaaaaaagttatatgttccttctaaaaatgggaatagaagctccaagagaattggaattttgcctgttgtgtccattctatccctagtgcctaaaacaatgtctggtacatattgctcaaagcatatttgattgaatagatgaaggaaggaaaaaacaaaacaacaaactaccacacatcagagccattcagagattgacctagataatctcatgcttagattaaatacagtcagatttttaaaaagtattccttacagtacatggcatcaactccatttatcatcctgctcatttgcatctaaattctctttcagttatgtttgtatcccacttcatgtaagggtgcaaaggtgaatgcttcccctagatgttgggtgaatagtgtagaaaagagttcatactatcaccttcatggtgatgattaaacatgttctgttagtacagcccaagattgcattatgtttttgaggtgatcatttcacaattattcatattaagccactgtcagttaagaccccctaattcttttcttcttcttttttcctttttttttttttttgagacagtcctgctttgtcgtcattcaggctagagtgcagtggctcagtcttggttcactgcaacctctgcctcctggttcaggctacctgcctcagcctcctgagtagctgcgactacaggtgcatgccaccacccctgcccaatttttgtatttttagtagagacggggtttcaccatgttggccaggctggtcttgaactcctgacctcaggtgatccacccaccttggcctcccaaagtgctgggattatatgtgtgagccactgtgcccagccaagaccctctaattctttcagagcattgcatactagaggaaacattaaaaaataattaatggtttttttgtgtgtaggtgcatgtatattttgttgtgatatgttttagacatcccaaaaagtatgaataatctatcatttgtatattcaccagttccccttaaaaaataaaaccttacggataattgaagcaccttcccgttcccattttcttatcttcttccctagagtaatcatcttaaatttgtaccatttctaggcatgtttttaaacttctgccacataagtgttcattttgtatgtgcagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccaggtatgcatttttgggagcttcagatatatttagaatcattcagtgaattaacagaataaatcagttatcattcagacagtgaagacagttgtgacagttaacctaagtgtggcaggtatacctctctagtttccatgtttcagtcagaaatttgctggtgaaatttttttcctattcaaaattaagtaggaggctgggcgtggtggctcacacctgtaatcccagcactttgggaagcctgggtgagtggatcacctgaggtcaggagtttgagaccagcctggccaaaatggcgaaaccccctctctactaaaaatacaaaaaaattagctgggcgtggtggcagacacctgtaatcccagctacccgggaggctgaggcacgagaatcacttgaacccgaaggaggaggttgcagtgagccaaggtcgtaccattgcactgcagcctgggtgacagagcaagaccctgtgtcaaaaaaaaaaaaacacaaaaaacaaaaaccaagttaagtaggaatttgagaattttagatatttatttgtttgtttgtttgtttgtttgttttttgagacagagttttgctcttgttgcccaggctggagtgcaatggcacaatctcggctcaccgcaacctccacctcctgggttcaagcgattctgctgcctcagcctcctgagtagctgagattacaggcatgcgccaccatgcccagctgattttgtatttttagtggagatggggtttctccatgttggtcaggctggtctggaactccgaccttaggtgatccaccccagagtgctggactacaggcgtgagccactgcacccggctgaattttagatatttattaatagataagtgtctttattaatttctttaatttcatctttaagaatttagtgaagggtattctgtcatagtaaaaaaccaaactttgaaatatgttttaagtaatttatttttagtaatatatctatactataactcttgagcatggtgattattacaaagagagctaaaaaaaaaaaaaaaaaaaaagggaaagcaaagaaaactgctatcccaaaaatactatgtagcttctgtaactgaaacaacctgataatgactcatgaatagacagactagtggaacagaatagaaaatctagaaatagactcagttgcaaataggagtttattatataataacaaagtggaacaggtcagtggggaagttatagacatgttgataaatagtattgggatgactggatagccagtagggaaaagatgaaataagatctgatcctttttttaaaaattatatcataaaccagtataaattccaaatggatctgagatttagatgctgattgaaagtctaaatgatacaaccctcatgaaaggaaatttggcagtacagtatctgcaaaaattatgcatatgcattactaaactagttatcttccttctaagaatctatgtcaaaggtataccagccaaaatatggaaagacatatgtgcaaggctagtaatgatatactctttataataacaaaagactggaaacaacccaaatacccatctgtaggggactggttactgcaaatgtagtatatctacacagtaaatatacaactatataaagaatgaagaatatttttatatgtaccatggagtgattatcagaatatattaagtaaaaaagcaaaatggaagaaaaaaatacatagttgactactgctggtgtgaaaaagtagaggcactgaacacagagaagtatttgcttttaacaggaaaaaaaccaaaaagataattcatattatttaaatcttgtggttatggcaagtatagaagaagctagatgacttttgattacgtcttgttttgtagatttaacttggaaccatgtaaataaattctgaaagtaattataaagtaaaattaaatgaaatagaagtaatccctaaaaagtgaaaagaaaagtgaaacacatgaactagcatatctgcattgagtgctttaaaacagtgatttgatgatgtattcctaatgtgatataccctgaggacaaaaaacaatttaaagaaagctctttctaatcatattgttgacagtgttgatattctaaaacccatctgtgagcattgtagggtaaatcaaatgaggaattacactgatgtccttgacaactcagactttcagtgtggttgaaaagagagatagaagatagataagactaagtaaatacctgtagtcctgcatttgaatagaaactatccgtattaactcaggttgtattttatcttaagcgggaaaaaaaaggcaacaaaatattccccaaacatttcccaattctattcactgaaaaggtctagaaataatgaccagcccagtcattgagcatccctagcactcaaagggacccagggatccttgaagaaatagctgtctccagacctgagactggcagtactgcagatgagcctagaatatggtatcaaaccagaaactaaggagggtgtcaaagattactagagtcctgtcaaagagaaaaacaaatctgatcaggcctctagatctacccactaatttaaaagaaatttgggggacagagggacatcttcaagggtaccacagaatcctatgggggagtactactggatgagtgacctggtttcttcaacaaacaatttgcaatgaaaagcaagagatagagagggaaactatgaagtaaaggagactataaagagatgtaacaagttgcacttacatggactttaatagatcccatttcaaatggggggaaattgtttagaatattataagctggaactggagaggtgaatattatggcacatgcaggactttcctgtgtaaactagtttaattttgatgataattaagtgttgtggtgattgagagaagtcttacatttggatataatatttatgtgattgaattttccatggatttcttcatattattttctatatctcttatattattcaaagttaattaagaagtttttaaaaagacgggtgcagtggctcacacctctaatcctagcactttgggaggctgaggtgggaggatcacttgagcctaggagtttgagaccagcctaggcaacatagagagaccctatctctacaaaaaagaaaagaaaccagctaggcttgcaggctcgcacctatagccccagctactctggaagctgaggtgggattgagcccaagagattgaggcgcagcaagccgtgattgcacctctgcacgctagcctgggtagcagagtgagaccttatctttaaaaaaaaagaagaaaggaaaactttaaaaaaagaacgtagcttaatacttagaaggatttttcagttactggaaacaagagtttttatttggcacttcacttacgaaaaacaacttgtgaaataccctccagccagataccacctgtagccaaacaaattcaacttattattcagtgagaggtatacacaatgaaactggatgccaaaaggacttattttaggattttggctaagttagatgatttagaaggatttaaggaaacaggcataaattctatgataggatatctcactaaatcttacctggaatgaggctaaagcagtaagtggtaaagaagcggcagtcattaccaggataaacagatgtttagtcattttatagtttggatagcattcatatttttgtctctgttcagtcatgattagggattggtcttgcttttgtcttgatctgttatggtcacaggagcacctttgtctgatgttggtgttttgtgaaattgtgtttaacagaagggtacttaggctgtttttatcttttgggtgacaaatttatgcataaagaactagattttataatgaaatttttaaatgtaaaaagaaaatttaactcctaagaagagtagaaatatatgcatcttttctaaaaaagtattctaagcatttctaagatataattatatttgtgtgtgctttttttttttctttattttttagatattttcaactccaggccatccaaaaatgatttacagctcctcaaacttaaagacaccttcaaagctctgttcagggtctaaatctcatgatgttcaagaagtgcttaaaaaaaaacaggtaacagtcttgattcttcttgccttacagaagaaaagatgccttgaatttttaagtggttacattatcacttttaaatcagttcatgttggcagggcataacatcataatgcttatttagcttcttctctaatgtaaacttggaaaaaaaaggtggacatacagaaaaaatgtttcacaattgccattcagaatttttttttgatacactattattccctccaattctagtgtttattttctttttttaattcctaggtagataatgattcatataaaatataagacttttgtaattattatctatatgattcagttctgagtttcattgtcatcctgttaagttcacatagggttttccaaattaaatagatatttatatgtactatctcagtataattagagatttaacaggagggtgggaggcaaaattttcctggtgaaatccatagattttactctcttatttcttatttcttttttttttttttgagacggagttttgctcttgttgcccaggctggagtgcaatggtgtggtcttggctcactgcaacctccgcctcctgggttcaagcgattctcctgcctcagcctccagagtagctgggattacaggcatgcgccaccacccctggctaattttgtatttttagtagagatggattttctccatgttggtcaggctagtcttgaactcccaacctcaggtgatccacctgcctcggcttcccaaagtgctgggattacaggtgtgagccactatgcccggcctactctatcatttctaacctatagctgcatgtcacttttttcttttcttttcttttctttgagacaagttctcactctgtcactcacgttgagtgcagtgtcatgatcatggcccagtgcagccttgatgtcccaggctcaaatgatcctcccaccttagccttctgagtagctgagtaggcatgtgccaccatgccctggctaattttgttcatttttttgtagagacagggtctcattctgttgccgaggctggactcaagcattcctaccacctcagcctcccaaaatgctaggattacaagttgagccaccatgcctagcctcacatttttaaactttaaacttaaaaaataaggatttagctattacattggcaagtgaaaacaactttggtttttcttcataaggacattcaggtcattcaagtcaataaatctcatagatatagctaattaggtccaatattttaaatattttttaagtacagttgtaaactctattatgctgaaagtgttagggaaaatatattcaaaggtttcatctatggtgtcagctatttttttattaggaggacagtctgtctcagggatgacccagaaaaaatgagttgagaatggtggcaaattacattatctgtattaatttcttttttacttatacaggaagcaatgaagttacaacaagatatgaggaaaaaaagacaggaagtgttagaaaagcaaatagaatgccaaaaggtaagacaagagctcattatttgcatgctagaattgatgtatagaattgattttaaaagtattattcataatttttaaagacttctttatattaaagtttattaagcatggttttacctttttctatttatttcgtagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggtatctatttgcattttttatttaacatagggttattgaacatctgccatgtgcttgacaccttgaaagtacaatgggacccttaggtagctaatatcctaacagggatataggcaaacaattatagtacttaaaaaaaaaatcctaattatagtaccttttttttttttttttttttttttaagagacaaggtctcactatattgcccaggttggcctcaaatgcagtcctcccaccttggcctcccagagtgctgggattacaggtgtgaaccactgcacccggctgccacaatttttttgttttagtgtttctgtagatgctctgtaccctttttgggaagaggttgataataccctgtttgaacaaagatgtgttttttaactgaatattttggttctctgctgaagatgacactattaaagtgatggtggtgaaagaggtatttcccatttcagcagtgtttttctaatgctgtaatagtattgtaataaaaccatcctttaaaaaaagaagcctggcctattcatatgggtaaaaatgtggcatgttattaaaaagaataatcagaagttttagatctatttaagtctaatttttattaatttccatgtgtttccttgctgtacttggtttagtcagtggttccattacaccacagttctgtggtgtgattatagataattctagtcctttgagaactggtaatgaatttgtcagatatgtagaatgtaaattgttatatgtagtattacattaaatttgaaattatggttctctatcagtatagaaacataaagtgtttaagatttcttcttaaagatataataaaaatgttttttattgaaatcttttctaattatagaaagaatatatatgcacattttaaaaattaaagaggtgaaaaaatcattggcagtcatgtcttttaaagactgataaataattcgtctctaacaaaaaagagaatgtcaacagttgtggattccaatctggtagtaattatgtagctgttactttgtattataaatacatttttactatataatttattttgctccattgtgtttcatttgtgatactttattatgtgacagttattctcagctccctcatctcaggtgtctgttcctaggatgtaatttttaagccgtctaatgcttactctttttcactgatatctatatactttttacatgttggcactactatatctgtaaagttacttttttaaaaacacccatgtttattgcatcctctcattctcatgttccaaaatacatgtgtgtcattgtgtaactatcatgttctggaggagatcttgtaagttatctaaaaaatacctttttattttcaatttttccaaaggcccagaaggagttattagatactgaactggacctccacaagaggctgtcctcaggagaagacaccacagaattacggaaaaaactcagtcagttacaggttgaggtgagatttaaaaggagttagcgccccaccacatttaacgtctcaaaaaagttttcctttgaccgggcgcggtggctcacgcctgtaatctcagcactttgggaggccgaggcgggtggatcacctgaggtcaagagtttgagacaagcctgaccaacatggagaaaccccgtctctactaaaaatacaaaattagccaggcatggtggtgcttgcctgtaatcccagctgcttgggaggctgaggcaggagaatagcttgaacctgggaggcagaggttgcagtgagccgagatcgtgccattgcactcgagcctaggcaacgagagtgaaattccatctcaaaaaaaaaaaaaaagttttcctttgtttttaaggtttagtctaataatgtatgctacattctactttttgttgttattcaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcagtaagtttttaaaatagcaaatgctaactgtaaaaacactgtgctcatcattttccttgctgcagtgtctataaatgtcagatgttttatagattagaaaaattagttgtaaaaaacatgagtactaccaaatgcctatttaatatatttaaaagtcaagaagcagctcttgcttttgattccataatactccacttaagtgcatttgtagtgacaagttgttccagagctatatttaatttttgttttaggattattacatggcttaccaggcatttatagttaatagtgaaacagtctgggatggaagcaaaattcaaataaagaatttattaggataacaggtatatttagttacattctgtatatagtggcaaccacttacttttaggcaaacatgcaaatagagatttgctacaggcaaatgtctttactgttttggacatatgcagtatatactctttccagccactcattcattcagtaaatattttattgacattatttgtgctagaacattttcatacatgatctcatttaattttaaatgactgtataaatgtgaaatacatgcaaactgtatatacatgcaaaactgtgtacatgtgaaatcctgtgtgtacagatgtgaacaccacaagttaaaatgtcaaccacaatcatataattaataagtagtggaaccaagataaccaggttccctattcctcaaacaactcttttgagaggaagtattttcagtcctattaagttttaaagatggccagggacaatggctcatgtctgtaatcccagcactctgggaggctgaggcaggtggatgacctgaggtcagtcaggagtttgagaccagcctggccaacatggtgaaaccccatctctactaaaaatacaaaaattagctgggtgtggtggtgtgcgcctgtaatcccagcttcttaggaagctgaggcaggagaattgcttgaactcgggaggcagaggttgcagtgagctgagatagtgccattgcacaccagcctgggccacaagagcgaaactccatctcaaaaaaaaaaaaaaagtattaaagatggtgagggaaatcataaagagcaaggcttcacttcaagtgtttttattagtttgatgcccattaaccctgtttcaccctgattcttggggaagataggccaagaaaagtgtccagatttgaatgtcctctgggttgtgaatggttcactcttgacccagttctttccctgatgtaacccttatttgccttttttgtaaagtgggagaatagctctaagtgacttcttgaggagtaaagaagatggaggaacactatacaagtgcagtgtattgtgaaggccgcacgaatgttgatttttgccttttaaggtttagtatataaaattaaaatctctttgccaaataaattggtcttgtagaaccagtaccagttctggtgaggtgatattggattatgtgaagcagaatttctacaaatttgactcattgcagaaagtttcagttacaaaaaatagttaatcttactagggagacagctacatgttctatcctgtggtcactggagactatatgtagatgtttaaattttaacccagaagccatgctcaaatggatctccttccttctgaaaagtagaaccattctaaagcatctaaaaataaccaatttttatgtacatatacctgacaagtctgcagtgtggcattcagttggcagatgtggttatgtctagacacttagaaaagagcaagcaaagctaaggcagatgaggtaacttcaagaacaaaacacttcctttgatttggatggctctttttttttcttttttgatagcatactatcagaaagggtattgagtactaggagcacacttccctgataataactacctgggcaatatagtatgctttctttgaaagaaatacagaaatacatattcttaggcattattgcgaatagagttagcaaacataaaaggaaactcttcttcaaggtcttttgtatctcacagaggccaaggtaaaatctatattttcagtattcttctattcttaatgattatgaaaggatcatgggtgagccatatctatatgagaaaatgatggatggattttaatgaagctatttggaatctaattctggagtccttcagagtttgctcttcaatagtctaagaacttatcataagtggattatggtcgtatgcaaatggcagctataagtatgctcattatagtgcatgtaatagtgaaaaatgataaccatgtaaatgtttgacagtgttttgctgcctttaaaaatgtattttttttgagacggagttttgctctcgtcgcccaggctggagtgcaatggcacgatcttggctcattgcaacctccacctcctgggttcaagcgattatcctgcctcagcctcctgagtagctgggattacaggtgttagccaccacacccagctaatttttgtatttttagtgttagtagtattagcatttctctattttccatacttcctgaggaacacatactcctttttttttttaataggtggttatcttttttttgttttttgttttctgttttttgtgacagtctccatctgtcacccaggctggagtgtagtggcatgatcttagctcactacaacctctgcctcctgggttcaagcgattctcgtgcctcagcctcctgagtagctgagactacaggcacgcacgaccacacccagctaatttttctgtattttttactagagatggggttttgccatgttggccaggctggtctcaaactcctggcctccagtgataactgcccgccggccgcgttggcctcccaaagtgctgggattacaggcatgagccaccgtgcccggcccacacatactacttttaaaatcagacttttttcttcacattcacttttgggatgaagcatcagtgttttatattatgtattttaaaaccaaatttgaggatattgattgatctcgatctttttggtcccaggtacttatatgaaaggtatatttacattaaagcatatacaaatttaaaatacatagaatatttaatttacagtgcaggttatatatataacagcataaaaacatacattaatatataaatatattaatagtatgtatcagagatcagcagactttttctgtaaaggactagatagtaaatactttaggttttttgtgaggagatacagatgatctcctttacattgtcttctctcctttcacctgctcttccctctcttcctctttcctttctagttctttttcttttttttctttttcttctttgtacttcaatggatgaacatatttttcttttaataaccttttcaaaaatgtaaaaaccattcttagctcctgggtcgttaaaaacagggtgctgggctacatttatcctgagggctgtagtatgcagacccctggtatgttattatgttactttatatatcaaatatttaagttaaacataattgaaatatataaatataattttatatattttaaagatcaaaatcagcgaatccagaaagaactttttaattttaatttttttttattttttatttttttggagacggagtcttgctctgtcgcccaggctggagtgcagtggtgtgatctcgactcccttgcaatctccgcctcctaggttcaagtgattcacctacctcagtccctccagtagttgggattacaggcgtacacctcctggctaatttttttgtgttttttagtagagacgggtttcaccatgttggccagcctggtctcaaactcctgacctcaggtgatccactgccttagcctcccaaagtgctaggattataggcatgagccactgcgcccggcccagaaagaactttttaaaaaatagaaaaatctttatttacctatctttatttcacagaaatcttaagatttttaatatcttaatgaagttaatgttaagtatttataattaaagtttaattcagaagctgaaaattttaactcagagccttgccaagggcacagatgggacaaaaactaaagtacttcatccctgttgaagggaggttcggctagatacaacaggaaaagttattttctctaaatatttggaatatatagactgtactttgatatttttcaagtagtgtggctcatttaactgtaagaattttgaatttttccttcttttcaagaagtctagagttaggttttaggattgatcaattcagaaattcagctgctcagattaatatatttctcttcttctatcctaccatgttgccttttattaggcttttttcctcttgccttgacctcccaaaatgttgggattacaggcatgagccattgcacctggctagtttttttttctttttttaaattcctgtttttactgttacttcttgatttctaaattgtaagcattatatattgacttcccattaatctttctgcttcccacctctccagtttttttttgaccttgtcgtgttttcttttatttttttgttacggatttataccttaaaaaaataaattattctactgtcatttcagtgggtgtctggggaagggtatgaaattgcatacgacagatggtcagttccccatctttagccagaagaccctttgagtcttgagaaagtaagaggtttatctctaaagtactgtttagaacctgtgctcccacaatatttatataattcgttataatttttatgttcttactggcaaaaacctctaatgtctcactcctgtcattcctggaacttcatatgaggcaacagaatacctctgctgtaattaccaaagacttcgcacatagttagcttttccccacagcctctcaagacagggattttcccccatcttccaagtatctgaaaaatatatttgagaattttactgtacatggaaatgatactttatagttaggcagatagttttcttttgtgctttccagaacaaaaattaaccttttctgtgtatttaacatttggagaaagttttttagatagtgcttcattgattgcccttcatcagaccttgttaaaaaagtaatgtaggcctggcttggtggcacctgcctgtaatcccagcactttgggaggctgaggtgggaggattgcttgagcccagaagttcaagaccaacctgggcagcatagtgagaccctatctttacaaaacaacttaaattaaatttaaaaggtaatatgggtgatttgtgagctatgaccatttactgttgttatctgtcacaagtgatcaggagtttaccttttctgcacactttactgtgttcagggttcttcaggtgaaaatataattttcgtagctagttctaggagtgaaatatggcaatggtaattctgtgacctttacaaagacattgaaactctaaactgctgtaattttttctcttaattttgaaaatttctttacaaaggtagttactgcttttagaacattcaaacaatacaaattataaaggagaaggcacaacaaatttgaaatcttaccaattacatttttatgaacatctttctagcacctgtatctgtcatatgtatacatactacccatgctgttttggagtttgtttttacatccatagtgtatcatggagaattgttcatgtttatgaatatagatatacatttgtcttatttgaaggcattctgttataagaatatgccataatttttatgtacagccccctattgatgagttaggtaggttgtttaccatttaactattatgaacaatgttatatacatcatgttagatttagcatatttactgggataatttttttttttttttttttttttgagacggagtcttgctgtgtcacccaggctggagtgcagtggcacgatcttggctccctgcaacctccacctcctgggttcatgccattctcctgcctcagccacccgagcagctgggaccacaggcgcccgccaccaggcccagctaattttttttttttttttgtatttttagtagaggcggggtttcaccatgttggtcaggctggtctcaaactcctgatctcaggtgacctcccacctcggcctcccaaagtgctgggattacaggcatgagccaccgcgcctggccaataatttttcattatgtgggacagtgctgcacattgtaaaacttctggcacccctggctaccacctactaattgccagtaagtgctacttagtcagtgtgactgccaaaatacctgctagagtgatgtctccaattgagaaccactgctttaggtaaattcctaggaaggagataactggatcaaaggcatgcattgaaattttggtacagctcgctaaataacccttcagaatgttgtactaatttatacttgtagtgacattggatgagagtacctatttgctcattccctcatatagcacttgaattttgtttttttatctgccagtcagttgattgatacatgatgactggcatagattgggcgtcagtttctaatcggggaaaatggctggactagatgaatttctctttgagcagcttctaccaagaaccctaatatgcatataatttttaatttatggtatatatagttgatctcatattcacatatatatgtattttatttgaattatttccttggccaacacacgtaaacaaaatgaaaaaggaataaaagtgtatacaatgaaaaataagatttccttctacctccagtcactcaatttcactccccatagacaattattgttacgagtttctcatacatctgcttaaagatattctctctctatatatattatttgttctctcttttataaaaatggtagcatgttatacaacaccgttttgccatatgtacttttactttatattagattttaaattgttctacactagtgcatgtggtgttgcttcattctttttaatgactgcatggtatttcattgcacagatatataatactacagttgaaccatcctgtattgatggacatccaattttttcccaatttttttttttttttgagacggagtctggctgcctcccaggctggagtgcagtgatgcagtctgagctcactgcatgctccgcctcgcaggttcatgccattctcctgcctcagcctcccgagtagctgggactacaggcactcgccaccacgcctggctaattttttgtattttgagtagagacggggtttcaccgtgttagccaggatggtctcgatctcctgacctcgtgatctgcccgcctctgcctcccaaagtgctgggattacaggcatcagcccctgcgcctggccttttttcccaatattttatcattttaaaccatatttagatgtgtatgtgagagaatgtatatgtatgtgtagaacaattaggtactgtaataagtaacaaatatgttaagagattaatcctagatttttttaaaaagtactttttagggctgggtgcggtggctcacacctgtaatcccagcactttgggagccccaggtgggtggatcacgaggtcaggagattgagaccatcctggctgacacagtgaaaccccatctctactaagaatacagaaaattagccgggcatggtggcgtgcacctggagtcccagctactcaggaggctgaggcaggagaatcacttaaacctgggaggcgggttacagtgagccgagatcgcgccactgcactccagcctgggcgacagagtgagactctgtctaaaaaacaaaaaaacaaaaaaaaaacaaaacttttaaaaataaaaatataatgtatgcaaatggttaaaaggatgactagggccaggtacggtggctcacgcctataatcacagcactttgggaggccgaggcgggtggatcacctgacctcaggagtttgagaccagcctggccaacatggcaaaaccctatctcaacaaaaaatacaaaaattagctagctgtggtggcatctgcctgtagtcgcagctactcgggagcctgaggcacatgaattgcttgagcccaggaggtggaggttggagtgaacccagattgcgccactgcactccagcctgggcaatagagcaagactctgtctcaaaaaaaaaaaaaaaaaaagtatgactaataaaagtaaaatctcccttttattaatctttttccattcttaaaagatagtcactattcttaggtatctttatagaaaaatactatgtatgtaagaaaacatatataaagcttctcactttaaaaacatttacgaaaatgtgatcgtattatacatacagggctgcattccaaaccttgcctttttcacataaaaatcttagctatctggtattcctttaattttttttttttttggagacagagtctcaagtcacctgtcacccaggccggagtgcagtggtacgatctcagctcactgcaacctccacctcccaggttcagggattctcctttcttcgcctcctgagtagctgggattataggcatgcaccaccgcgcccagctaatttttgtatttttagtagagatgaggtttcaccatgttggccagctggtctcaaactcctgaactcaggtgatctacctgcctcagcctcaaagggctgggattataggcatgtgccaccacgcccgacctatttccttaaaatttttaaaggttatacctatagtcaactaaaaatgtttataaaaaccaactatactgatcataaacatatagttcaatgatttatgagaaggcaaacacctaatatacctatacctcaggtcaagaaatagaacatttccaataccccaatctcccttgttgctccctccagcctctatctatcttctctccttctcagagcagtaactgttagcctcactttatgatagtcaccttgctttctttatacagtcaatccttattattttcagattccacatttgccaattcatctactcactaaaatttatttgtaaccccaaaatcaatacttatggtgttttgtggtcattctcagacatacacacagttgccagtcccctcatgagcccgttttcagctgagatagaaataaggtggtgctatgccttcttgtttcagcttttatactgtaaacaaatgccccttttgcagtctatttgttttatttatttatttatttatttttgagacagagtctcgctctgtcactcaggctggagtgcagtggcatgatcttggctcactgcagccttcgcctcccgggttcaagtgattatcttgcctcagcctacctagtagctgggattacaggcgcccaccaccacacccaactaatttttgtatttttagtagtagagacgaggtttcaccatgttggccaggttggtctcaaactcctgacatcggcctcctaaagtgctaggatgacaggcgtgagcccctgcgcccagcctttgcagtctatttaatgccacatttttctcaattttttttgttttcttggtgattaaactgttttaaatggcccccgaatgtagttctaaagtcctgtctagtgttcctaagtgcaaggctgtgatatgccttacaaagatacatgtgttagttaagctttgttcaggcatgagtgagtgcttttggccatgagttcaatgttaatgaatcagtaacatatattaaataagatgtctttcaacagaaacacataaaaccaaagtttgtgttgattagctgacaaaaatgttgtgaccctctaaaacaggagtgtccaatcttttggcttccctggaccacactggaagaagaataattgtcttgggccacacataaaatacactaacactaatgatacctgatgaacaggaaaaaaaaatctcatagtgttttaagaaagtttatgaaatttgtgttgggctgcattcaaagccatcctgggccatatgtggcccatgggccacaggttggacaaggttgctctagaggctcataagagtctaattctatttcccctataagtagtggctatttgccagttaaatgtttgcatcaactttttagaacaaaactactgcaagtaatgagaattgactgtagttttatcacctaaatatgcattcctaaatattagagtagtattctgcctgtttttaaaatgttatgtaaatggaatcacacagtgtatattcttttgtgcttggcttcttctgtttaatgtttgtgagactcattcatgtttttacatgtaacattaatttgccatttttattactatataatagttgtatcaatataccacagtttatttttcatctttttttttttttttttttttgagatggagtctcactctgttgcccaggccagatcacagtggcgcgatctcggctcttggcaacctccacctcatgggttcaagcgattctctcctgcctcagcctcctgagtagctgggattatgggcgtgtgccagtacccctggctaatttttgtatttttagtagagatggtgtttctccatgttggacaggctggtcttgaactgctgacctcaggtgatccgcccacctcggcctcccaaagtgttaggattacaggcgtgagccaccgcacccagcctcatcctcttactgatggatgtttgggttatttctactatgtggcttttgtaagcagtgttgctatcttatacatgtttttaactacacatgtacacaccatttctcttggatatacagttggcccttcatatgtgtgggtttcacctccatggattcaacctattttggatcaaaaatattgggaaaaaaatgaaaggttgcatctgtactgagcatgtacattttttgtcattattccctaaacaatacagtataacaactatttacatagcttttacattgcattagatattataagtaatctagagaggattcaaagtatataggagaatgtgtgtagattacatgctaatactacactattttatgtaaatgacttgagcattcatggattttggtattcacagagagtcctggaaccagtcccccagaaacaccaagtgatgactgtatgtggaattgctgagtgaaccccatcagttttagattcttaccagtttagaatcagtttgagattctcaccatttgtgtatgagaattcctaacttggtagcgtcataatatatctttattctaattgctaatttatttgatttgttgtaagttagatagtagaaattatttgttcttaatttcagactctgtatacatttcttattcttcctttaataatgtatatgcaatacatttaatgccttaatattccttttggaggacagacctcttatcctctttggagagcaacacagttattacagatttaaaaatctttattactttttctgtttataaaagtaatatgtttttatttagaaattcaaataataaagaaatgaacaaaacaagcagggaaagcctctctataattgggctgtgtgttaaaggatagagtaaagggtaaaggatctctgttacgtacattacctaatttttaaaagatggtaaatatagaccaggtgctgtggctcgtgcctgtaattccaacactttgggaggctaaggtgggagaattcctcgagcccaagagtttgagaccagcctgggcaacatcgggagaccccgtctataaaaataaaaaaattagccaggtgaggtggtgcatgcctgtggtctcagctccttgggaagctgaagtgggaggatcacttggacccagggagtcgaggctgcagtgagtgtgatcttcccactgcacattccagcctgggaatcagagcaagaccctgtctcaaaaagaaaaaaaaaaggtacatatctatatttggtagggctattttgatacatcagtttggtatgtcccatgagtcataatgtttggtgttaggttatgagcatttagacccttcaaggaatggtgggaatttttcccttagaacacaggacgatgtctgtgcaggcagtaatggatttatgagtctgctctaatgtacattctcaccatgctatgctccaagtgttttatggaaacatttggcaaatgcttcaggaggtttagcaatgattttgctagatagactagaatgaaagcccaaataaaaaagaatctcttctattatgttttttagaacccccagttctataaatgaggacctttgataggaaagctatagggatggctaaacttctacttttctgaaactttggatccctagtcccttgtctgtgttgctttgtctttaaaatttgctttcccctattggaatttgctggggagaaaaaaatgtttaaaaattagtaccaagtaacatttgaaatggagcagttttatgagttaggatagtattaggcatttgtttaatgtttattgaatgcatagatgagctgggaggtgcttattagtgtatagcgtttcagaagtggaaataagaagaactttatccaacataggtggggctgtgagagatgcagtgagatgaataagcagatgattcaccttttttctaaggtttgagtctatatatgtagatatcaaagccaaaggtcaatacctgtattaagaatatttcttgtcctcatcatgacttttgtaagtagagcaactctacttagaaaaaaaattatttcttcaaccaagacagatgctaacatttacctgacacagatataaaccatgggttatcctaggcaaaccagaacatatagttgctctaattaaaagggactttattttttttagctctcattggagattgtagatccaccttaacagatttctctcctgccctatgttatactttttaaataacacagaatttgcagaaatcattagtaaatttgagtgcaaacttgtatgttcttctaatatatattttagaccgcaaaccaagggccaaaatttaaagaccgtcggctacagatatcatggcacaagcccaaggtaccatctatatccactgagactgaagaagaagaagtcaaggaggaggtaaatttagtggttggaaataagagttgaattagatcacttctcaattatgtattttttatgatattaaatagtataaattaaaaaatgctgggtttttctttcatgcatgcaaattaagacccgtttagatgtttattagagaattaaaacaggtctagagatataagaagctgtgttaggggttattttcttctgatataggaaagactgttcttttttgtttacatttatattggatttatttgagctctagaaatttttattctgatgaataaagtcagagattacataaatgaattaaactttaattggttggtttcactttttgtttattcaagttccatagtaatagatttgagtttcttattttccttctgtgtacaattggttaaaatcagagtgtgcagaagttgaacatagaggagagaattggaaaactaaagacctaaataataaaagtactgaataatcagcttcttaaaatatatgagaatttattttgcttttttactcctgttgtttatcattagtttatttagtgaacacttaggctatattgcgaggttttcctgatttatatgacaatcttggttttaaaagatacctagctagcatttatagtttgatcaagtgtcttctcactatataggtaattttacacagcaaaagcagaaatgttccctagattaaaagaaaaacagaagtcatggtatttgggtagtgtttgcagatacatctactttgtctaagattttagatttttatataagatttggaatatcagtgtcatggggaagctagtatattcacctctcacaaacaattggatggatataaaaacaaagatttaggtgtttggtcatttattttcctaattttttatagaataaaattaattttaatttatcagaaatgtatctcatagtcttttttaaattttctgtactaaatgtccacattattttcctgatgatattagagtagaaatctcctattaaaagtagcaaaattagcaggggagaagaattcatattcatttacaaaaatattttgggcttttttttttttttgccctgaaagatactcttgcatgcatcccttatgaaatctagcctgggctttgtatactagcctgtttgtcctttggcctaaaaagtattttacttaccattcttgtgccactaagcagattttaacctctctttcttcaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattggaaaaaaaaaagaaaaaagatgaaagtattacaaatttaaaagaatttggaaaatttatgaaccattccaaaaattataacaatcaccaa

SEQ ID NO: 2217 - DNA, 62857 bp, Homo sapiens
cagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcgggtgagtttgtgtctctgaacgcgtgtggaaaccgggagaccgggtgcctcagctggtggaggaggaaaagccggggtggctgcgaaagcgccagggtggggtagaggtaagggggagcgcggaggcgggggtgggggaggggtcggcacgaggcttggtttcttctcttctctaaggcctggaaaagctgtgggcccagccgtagctggtggaggccagacctacggcttgagctttccgtcttgcattgtcgcccactttccctttcccttccacgttccgccgcggagtgaatcgtctctgccccccctgggctccacgttagatacaaaacgatcgatctgccccaggggagcccttccctgagcccccttacttaccggagccccacagtaggttttcgggcctgggacactctcgccccagccgttgccttgaagttagcctctacccaccctttttagcgaggtgctggccaccaacggatatctttcccttcctctttggccatctagagcccgccaccaagtgaactgggccccacccccttggaattgagctaatacctacctttttagcagtctcctggcttgcttaagatagtcatgaattttgccatcctgcctcttttgcgcattggagggtgcagtaaactgtatatcgccattcattctaggcgattactaagctccacattaaaatgttactttctcatttttctttggtcgtcaatcctgcttttaaatacggttttccggaatagacgtaggactatgaagatttttcggaggttatgtaatatggatttgtattgccatggaaatgccattttgatactgggcagagtggagccaagagaagggaagagattggacctctgttgcaccctactgctgtattagtgtgaagtactctgtgtattaggccgtgggcagtaatgtataaataatttttgtatagtctttggagcttttaatttttttaaaggctatttccaaaaacattcagaggacttgaaagggattaagttggtcataagttactcatgattcaagtgaatcttatagtattctaattcatttaacttaaagccttggtttttctttttcttttttcttttaagctttggtttttgttcctctgtaaaatgaatttatagtagtatctatacgttattggggttggggattgagaaaaacgtatgtaaaatccttcgtgcagtatccaggtaacacacataagcatttaaatctatattgacataatttgttatttaaggattttcaatgaaatgtaagagtccaaccctgactctgtaatttttttttttgttttgtgttgttgttttttttaagacggagtcttgctgtgttgcccaggctggagtgcggtggcgcgatcttggccactgcaacctccgcctcccaggttcaagcgattcgcctgcctcagcctcctgagtagctgggactacaggcgcgcgccaccacgcccggctaatttttgtagttttaatagaggcgaggtttcactatgttggccagaatggtctcgatttcctgacctcgtgatccgcccgcctaggccccaaagcgctgggattacaggcgtgagccaccgtgcccggccttctgaatgtatttttaaagtaaaactagtccatgttaacattgggtaactacttcagacctaacaggaatttggaattttcaagttatgtttttgtccacagacaaattagcagtttacttttcttatttacacatgatttagtgaaaatttacattattttatagctttggaagcaaaggaatcatttatcaatcttaacatcttgctaaaacagtctgtattttagagatctcttgattgacttttcaaacactatcactgccattcacaaaaggggatttttgattcttcttaaatagcttttctacctttttttgaaaattgaaagttgctgaaactagaagaacaaaattccactacccagaattattggtattggcttttaactttttatttagacataatttcagatttacaaaaaaagttgcaagaatagtacaaaagaaatctcagctatctttcaccagattcctcaaatgttaacattttgccaatttgctttatccttctcttcataggtttcttctgaaatgttttgctagtaagttgcagatgtgatgccccttaacccataaatacttaagtgtattttctaaaaattaggactagtcttacctaacaacagtacgacaatcaaaatcaggaaactaacactgataaaatacctaatctacagttcttaaatagattttgccgatttttctgagttggtgtacttttttttttttttcctttttggagatggagtctcgctctgtcacccaggctggagtgtagtggcgcgatctcacctcactgtaacctccgcctcccgggttcaagcaattctcttgcctcatcctccatagaagctggaattataggtgcctgccaccatgcctggctaatttttgtatttttagtagagacggggtttgaccatgttgtccaggctggtcttggaacttctgacctcaggtgatccacccgccttggcctcccaaagtgttgggattgcgtgagccaccgcacttggccaatatgccttttttaaaatggcagctatatgaactatattgacatagaaaattcacctgtaagtgcacaattcaatgatttttggtaaatatacaaagttatgcatccattaccccaaaaggattccttctgtctgtttgcaagtcaccctgttccaccccagtttcaggcaagccctcatttttctgtatagatagtagtagatagcgctgcttttttgttttatttggtttttgagatggggtctctttcacccaggtggagggcagtgctgcgatcttggctcactgcaacttccgcatttcaggcttaagcaatcctcccaccccagcctcccaagtagctgggaccacaggtgcacgccaccatgcctggctatttttttgtatttttggtagagatggggtttcaccatgttgcccaggcgggtctggaactcaggctcaaaggatccacctgcctcgtcctcccaaagtgctgggattacaggtatgagccactgtgcccagccttgtttttgtttttaaaaagatgaattcttcctgtgttgctcaggctggagtgcagtggctattcacaggcgtaatcccactattgatcagtttgggagttttgcccttctctgttggcaacctggtggttctctctcatcccaggaggtcaccatattaatgctgaatggacttagcatgaacacctgatcagtagcgtgctgcagcccagaactccagggctcaagtgatcctcctgcgtagctgtgactataggcaggcacaggagtgttgctctttaatcattgaaaatggtaaaacaacaaaagtggcaatgtcagaaaaagatcaactcttttttggagatttccaaacaattgagtattttcatacttctgaaaagctttgctgtaaaagtagtttttctgttaagcatttcccattcttctttgggcataaaacacttttttttttctaggaataattcctgcagacctgacacataattggaagtagatattgaatgaatgagtgagttgtatgtgaatatttgctcagaggaatctcagttcattatcatttcagaaatttggcacgtagtgtactgatggagctagtctaaaataatctatcctgggagaaataattttgtttctatctggataagtctacaatagaggaatgcttattagcagtgttttgctgtattttgcatacttgcagtattcttaagagtgcagaaaaaaatagtttgaaagattcaaagagaaaaaagtgaaaaaagaaaagctgagtgcatgcatatgttgagtactagagatatgtcttcagggtttctttttggaccagatttcttgagataaaatttgcatacaataaaatgcatctgttttaatttcaatgagtttagacaaatgcatatacttgtgtgaccaccgctacactagaggtagggaacccttctatcataggtttctgttattttatttaatttttggggggcctcactctgtcgcccaggcttgagtgcagtggtgtgagctcggctcattgcaacctccacctcccgggctcaagcgattctcccatctcagcctcctgagtatctgggaccacaggtgcatgctaccacacctggctaattttttgtatttttggtagagatggggtttcaccatgtcgcccaggctggtcttgaactcctgagctcaagtgatctgcatgccttggcctcccaaaacgccgggattacaggtatgagccactgcacctggcccaggttcctgtttttattatcgtgggctatagagtttcttttttttgagatggagtctggctctgtcgcccaggctggagtgcagtggcacaatctctgctcactgcaagctccgcctcccgggttcacgccattctcctgcctcagcctcccgagtagctgggactacaggcgcctgccactatgcccggctaaatttttgtatttttagtagagacgagatttcactgtgttagccaggatggtctcgatctcctgacttcgtgatccacccacctcggcctcccaaagtgctgggattacaggcttgagccaccgcgcccggcccggagtttcatacttagcaggaaaaggtgctttgaaccttctaaaatgtgaggtactttcaatattttaaaaaatgctatggaaatgatttcagtgccataagataactctgcatttctctcttttaaatcccacatattatacaatccctcagcaaatcctattggctgccttcaaaatatatccaggatccaacaacttgatagcactttcaccactaccacctgttccaggccaccatctctccaggctaccatctcttatatggattattgtaccagtctcttgcttgtatcctgttcccttccaggcttaacacagtggccagtgatactgttaaaatgtgacaagtcagaaactcttcaaatgattttcacctcattcagagttaaaactaaaatgtttatttacattgtgttacatagccctacactctactcataatactcagtatttatttctgattttcttcatttattctgctccagtcatactgttggccttgctattcctccctcaaatacaccattcctgcttcagcctctttgtatttgtcttttcctttgcttggaagtctctttcccccagatatgaatagggcttcctgcctctgcctcttttaaatctttgttctaatcttcaccttcttggtgaggcctaatcgctgtatttaaaataaactactccatagctctcttccctaatttatttttctacaaagtacataccatctttcaatgtattataatttattttgtttatcatctataggtaacagataagctttgcttatgattatgaaagttaattctcaatcagtttcacatggcaaaacacataaacctgtgttgaaataagtagttggtaatcttttaggctgcttaaagtggacattagtatttatcaaagatgagaaatgttttctgattttccatgagagaccaatcttttttatttttgttttgaaatggagtctcgctctgtcacccaggttggagtgcagtggcgcggtcccagctcactgcaacctctgcctcccaggtttaagcaattctcctgcctcagtctcccgagtagctgggactacgggcgcctaccaccattcctggctaatttttgtatttttaatagagacgggctttcaccatgttggccagtctggcctcgaactcctgaccttgtgatccgcccgcctcagcctcccaaagtgctgggattacagatgtgagccaccgcgcccaggagaggccagttatcttaaaggaatatccataaaaattagctgttaactggtatttttgccttcacctttgaagtccagcctatcaacaagcaagttttggcagctccaaataaaggggaatatgttatggaaaaatttgaagtgaatggaatgggtatattggcataaacgaaaattaaatatatctggttaactctgcagaatgaattacacatttaaaaaccataaaatataacttaaataccaagaatatagagttttactttttttttttttttagacggagtcttactctgtcgttcaggttggagtgcagtggcgcgacctcggctcactgcaacatctgcctcccaggttcaagcaattctcctgcctcaccttccagagtagctgggattacaggtgcgcaccaccacacctggctaattttgtttgtttgtttgtttgttttcttttgagacagagtctcactgtgtcacccaggctagagtgcagtggcgcgatctcggctcactgcaacctcggcctcccgagttcaagtgatctcctgcctttgcctcttgagtagctgggattacaggcacccgccaccacacccagctagtttttgtattttagtagagacggggtttcaccatgttggccgggctggtctccaactcctgacctcaagtgatcggtctgcctcggcctcccaaagtgctgggattacaggggtgagccactgtgcccagctaattttttttttttttgaaactgagtcttgctctgtcgccaaggtggagtgcagtggcgcagtcttggctcactgcaacccctgccacccaggttcaagcaattcccctgcctcagcctcctgagtagctgggactacaggcgcacactaccatgcctggataactttttgtattagatacggggtttcgccgtgttggccaggatggtcttgatctcctgaccttgtgatctgcctgccttggcctcccaaagtgctgggattacaggcatgagccacctcacccagcccagtgtttatatttttagtggagacaggggtttcaccattttggccaggctggtctcgaactcctgacctccagtgatctgcccgccttggcctcccaaagtgctgggattacaggtgtgagccaccgcccctgaccgagagttttagtttttaagcattatttatatctaatattattgggggaaaagtggttttaaaaatgagttcatggcccagtcttgtaaccattgtgaggctaggcactgggccattgctagaatatagtatgcggcatgagatagcataataaatttgtttattgaagtcctcagagtttgtttactgatttattcattaatcagtttattcaacaggtatgaaaaccaactatcctaagaaagcactgagataggctattataatgataatagaagagcttctgtaagtaggacagtagccctttctgttttaaaaagagataccacccccagtttttggttttggtcaaaaagttttacagaaagtttattttaaaactcaacacatttacagtcttgcaatcttgtgtttttcattgttaatatgtactgataacctacctactgtttaaaacatttctaatacctcatttgccaagtatattaaatcctcctaagggctgggcgcagtggcttatacctgtaatcccagcactttgggaggccgaggccgacggatcacttgaggccaggagtttgagaccagcctggccatacatggtgaaaccccgtctctactaaaaatacaaaaattagctgagcttggtcgtgcgtgccttgtggtgtgcacctgtaatcctagctacttgggaggctgaggcaggagaatcgcttgaacccgacaggcggaggtttcagtgagctgagatggtgcctctgcactcctgggtgacagagcaagactccatctcaaaaaaaaaaaaaaaaaaatgcatcctagggattcctttacctataaagttttctaaatattttaagtatactgtgttttctgaaattgaagtttagttttattgaatatggtattatcccaatttaagtcaaaggaattctgaggaagtagagctgtgagcatgtaggtcatgcttttctgttttaaagaaatgtctagtaaacaggtaaacgcatactcaacctcattagtcatgagggaaatgtaaattgaaataagagtatattttacttatgaaattgtgagaattttgacactgatctattctaccaatgatgaggatatgaggaaagggcatacccatattctggtggtgggaatatacatttatatgctagttttcagggatgattttggaggtaaagtttggatacatataattttttttttttttttttttgatgtggattcttgctctgtcgcccaggctgacgtgcaatggcaccgtctcggctcactgcaacctccgcctcccaggttcaagcgattctcctgcctcagcctcctgagtagctgggactacaggcacctgccatcacacccagctaatcagatacatatagttctaacctgtattagagaattacctgtacagatgcatacagttatatgtctattatctccaggaatgttcaacattatttgtgagagctgaaagtggagccaactgttaatgttggttaaataaatatgtccgtattataataatttactgcattattattattttattatttttgaggcagtcttgctctgtcaccaggctggagtgcagtggcttgatctcgggtcactgcagcctccacctcccgggttcaagcaattctcctgccttagcctcccaagagctgggactacaggcatgtgccaccacgcctggataatttttgtatttttttcatgttttattgcctgtatttttttttttttttttgaaacagagtctcgctctgttgcccaggctggagtgcagtggcgcgatcttggctcactgcaagctccgcctcccaggttcacgccattctcctgcctcagcctccctagtagctgggactacaggcgcctgccaccgcacccagctaattttttttttttttgtatttttagtagagacggggtttcaccgtggtctcgatgtcctgacctcgtgatccacccgcttcggcctcccaaagtgctgggattacaggtgtgagccaccgcgcccggcctgtattttgtttttatatgtatcattaattcttaaaaattaagattttgaatctctttggatatttattaggcttcaaagatcttgatggagcagtctgagttgactgccagtttcttaagttggcggtaaggctggggtgcagcgcacactggtttagcgtgagcagtgatcactaagcacatgagctacgaccaccccaactttacctcgttcacagacagaactggaaggttggtcctagatggctgcttggtcctggatgctttagtggtctcttgatatgtggaaagccttgttttggaacaaatgtttccattgatacagatgagaaatgcctctttaatatttttataaaccatttagaccccaatagatttggtttgtgggtcactctcttgtgagtaccaaaggatttcatggttggaaggtgtgccttttcgtcttggcagtgagcagcatttaatggagagacaatgcttgtatttgattttttttttttttttttggttcatttacaggatctgagacttattcagactaccagctgtattatcaggaaggaacaaatccaagttttgacgtattgtcagtgtgccgcatgttgtattttcaaattcctttagtggttttaacattagatgaccaattctttggcactgatgtgcttttgccagtgtacggtagatctgaccatggctctgagaagtctggctggcattaccacatcccaagctctctgtccaaagagaaggaagcgccagggacgcacgcttccttggctggactgcaggaaaagagctgcagcaccagcctctcattactgcagccaccccctctcctaatttttgtatttttagtagagatggggtttcaccatgctggccaggatggtctcaatctcttgaccttgtgatccacccacctcggcctcccaaagtgctgggattatgagcgtgagccaccacgcccagccaatttactgcattataaaggtggaataagactttatttttattttttatttttttagacagactctgtcacccaggctggagtgtagtggcacgatctcagctcagtgcaaactccgcaccctgggttcaagtgattctcttgcctcagcctcccgagtagctgggattacagacatgtgctaccacacttggctgatttatgtatttttagtagagatggggtttcaccatgttggccaggctggtctagaactcttgacctcacgtgagccccctgctttggcctcccaaagtgttgggattgcagacgtgagccaccatcccggcttggaataaaacttttgtgaactgacatgaagagatggcaattataacgagggagaaattcacatgatgtgattggttgtagaaaaataaaaattattagttcatagaatgatattaagaagagcacagcagtagataccaaactgttgggattgggggcaaggaagtggaagacttaaactttttatgttttctctttttatgtttctgtaaaacatgaaagacaaaatagtagagacaaatatttttgtttgttttttgagatggaattttgctcttgttgtccaggctggagtgcaatggcacactacaatctccacctccctggttcaagcgattctcctgcctaagcctcccatgtagctgggattacaggcatgcaccaccatgcccagctaattttgtatttttagtggagatggggtttctccatgttagctagactggtcctgaactcccaacctcaggtcatgtgtccgcctcggcctcccaaaagtgttgggattacaggcatgagccaccgtgcctggccgaccctgtttcttaaaaaaaaaaaaaaaaaaaaaaaaaaaaaaaaagtgtgttgctgaaaataaagtttgaggtgaaaaaaaaatttttttctttcttttttttttttttttgagacagggtctttctctgtctctcagcctcaagccatcctcctgcatcagcctcccaagtagttgggaccataggtatgcactatcatgcttggctaatttggaaattgtttttaatactaaaaatgctaatgtttaaatattaacattaaatggcaatacttaataaaatgacaaagttttctttaacatgacaaactaagtgaaacagttaaatgtgttcttttttttctttttctttttcttcccaccccgagacagagtcttcccctgtcacccacgctggagtgcagtggattacaagtgattctcctgcctcagcctcccgagtagctgggattacaggcgcacaccaccataccctgctaatttttttttgtttgtttgttttagtggggacggggtttcgccatgttggtgaggctggtctcgaactcctgacctcaggttttccacccgctttgacctcccaaagtgttgggattacaggcgtgagccactgcaaccaacctgttcttaaactttaaaaaatcaaatgctagcttctgattcttcagttttgattcaagaatggttacaaagtttacttttaagtttaaaaaaaaaaactatgacttttttttctcttgtcaaaagttgtatgttctctttatatttgaatggttactatctgactggaagtcaggagtttatttccccctgctgagatgtatggttcatgagcacatttgtctcttaggtagtggccagcattgaagcaacaaatactgtgtaacttggtacctttagtttttaggattctgatagatataagaaaaatgggccgggcgcggtggctcaggcctgtaatcctagcgctttgggaagctgagtcaggcagatcgtgagatcaggagaccgagaccatcttggccaacatggtgaaaccccgtctctactaaaaagataaaaattagctgggcgtggtggcgcgcacatgtaatcccagctactcaggaagctgaggcaggagaattgcttgaacccaggaggtggagattgcagtaagccaagattgcaccactgcactccagcctggcgatagagcgagactccatctcaaaaaaaaaaaaaaggccaggcatggtggctcacgcctgtaatcccagcactttgggaggccgaggagggtggatcacttgaggtcaagagatggagaccatcctggccaacatggtgaaaccccgtctctactgaaaatacaaaaattagctgggcgtggtggtacgctcctgtagtcccagctacttgggaggctcaggcaggagaatcgcttgaacccgggaggcggaggttgcaatgagcagagattgcgccactgcactctagcctgtccacagagtgagactctgtctcaaaaaaaaaaaaaaaaaaaaatcagaacacttaaaaactattagatacccatctgaattctcagtttggtctaaaaagattcgtttatgtgtggtatttaatttttggatattaactgaacctcaaaatttttttcttcctttatatgtattcctacatgattgtaggagtctgtcctgaacttcgatcatgtacattttggaaacttattttagaaaaaatctaagtcgtaagaattctcaatgaaaagagggtctttgccaatttctttgggtaagaaaagttcagaattttgcagatactctaaaaatgaaagtcaacaaagaaggcatataaaattgtgacgttttcaaataaaatgatttgtcatgtccttttttctttagactgctgcagtaagaatgtcttttccacctcatttgaatcgccctcccatgggaatcccagcactcccaccagggatcccacccccgcagtttccaggatttcctccacctgtacctccaggtaagtttgttgatactgttttttgtcgttaaacttgtacttttgtctttgtgatactaacttcaggaaaatgttagatatgtgactgtgttagtgaagatgcctctcagcgttgtttgggaaatgtggatgtctctttttcctatagcagtagcttttatatctggctgagtatcaaactcatctggaaatttttttttttcttctcatctggaaagtttttaaaaaattctttttttttttgagctagagtcttgctctgtcacactggctggagtgcagtggcacgatctccgctcactgcaacctccacctcctaggctcaagcagttctctgcctcagcctcctgagtagctgggattgcacgcacctgccaccatgcctggctaagttttatatttttagtagagacagggttttgctatgttggccaggctggtctcgaactcttggcctcaaatgatctgccggcctccggctcccaaagtgcgggattacaggtgtgagccaccatgcccagcctaaaaattctatatttaaaaaaaatgggtaatacatacacattgttcaaaaacaaaaaaaaaatacagaaagtaatacagtgaaaaattttcttcatatactcccataactgctattgctatccccttactaaaaagggaagcaataaggttattagttttttcttgatttttccagatacttaaaagtgtatattataagtcaatataagtaaagatttatggagttaaaaaaaatgttcagaccctgctccatccccctgaatcagatcctcagaaattggggctcaggattcttaatttttaacaagttcacaggtaatttttggcactcatttaagcatggagaatccacatttgagaaccattatcctgaagtacatagtgaacattgcttatgctgggtgtggtggtgcgtgtctgttgtcttggctattcaggagactgaggtgggaggatggcctgagcccaggagttcaagtccaaagagtgagacctcatctttgaaaaaacaaaaatctttgcttataagaaatttttcttttgacttaagaacattgcagttggctgacttatgatgggttgttaattcatagcatgtatgttacgggggttgtataaacagcacatttgtctttattttgtttgtgtgtgcgtgtgtgtgtatgtgtgttttgggcgaggcctcactttgttgcccagactggagtacagtggcacgatcatggctcactgcagccttgacctcctggactcccatctcagccctcctgaggagctgggaccacaggcttttgccaccatgttcagttaattaaaatttttttaaaaaacattttataaagatgggggtctcaccatcttgtccaggctggtcttgaacttctggggtcaaggtatactcctgcctcagccttccaaagttctgggattacagatgtgagcccctgcacctgaccttgtctttattttggattcaactactcattgtaaaatttttaatttactgccacaggctcagctttgggaaccttctacccttgggtctgaaaagccccaagataaatatgggaatttctgtggaatattatttaacacttcaagaatttggggaaaatcataatttaaaaaaatcaggccgggcacagtggctcacgcctgtaacctcagaactttgggaggccaaggtgagtggatcacctgagttcaggagttagagaccagtctggccaacgtggcaaaatgccatctctgctaaaaatacaaaaaattagctgggcgtggtggctcaggcgtgaatcccagctactcaggaggctgaggcaggagaatcgcttgaaactgggaagcagaggttgcagtgagctgagatcatgccactgcactccagcctgggcaacaagaatgcaactttgtctcaaaaagaaaaaaaaatcagaacaactgtttatgcatgtatattatggaatagaatgcagtactttaataagctattttagacattatgcttgtagtggagctgctttacgctgtgcttctagataatcatggatgtatatttgttatcatctgctgccagaagagtaatgtaaaagtttacactactgctttattatcccatgtaacaattactgattttaagtagtaacttagttgttttataatggaccataaatagactaaattctactggaaggctctagctggccctttggacaaagttttttcttaaaatgaattttgctgaaaggaaattctattgagaaaattgagaaaatgttgcagaaaactgaataaagttagttatcagccatcaaacagattaatagttatagaaggaaagtgttttgaacaactttcatttgggcttcagttttctctttggtccgtatatcctgattttcttcatatatttataggctcataatgcagttctgggttttaatttttaatttattaatttttttgagacaggatctctctttgtctcccaggctgggggtacagtggcataaccataacttaatgtggcctctatctcctggactcaactgatcctcctgcctcagcctactgagtagctgagactatagatgtgtgccaccatgactgactcagatccgtttttcgatgggccttaccataaccatgatgcaaagcccgagtgttctagaagttataggctgggcatggtggctcatacctgtaatcccatcactttgggaggctgagggcaggaggatttcttgaacccaggagttcaagatcagcctggacaacatagggaagaaagaccctgtcttgtggggaggtggggggtggcagtaagcttaattgcttgtttagaatcagaaaagatggttatggagaatctgtgctttaatttccttaccagtagattgggtttatagaaaagattttaaatttctttgatttttttttttgtttgttttgctttttttgagagagtctcactctgtcgctggagtgcagtggtgccattacagctcactgcagtctctgcctcctgggttcaagtgattctcctgattcagtctccctaataactgggattatgagtgtgtgccaccatgctcggctaatttttgtattttctgtagagatggggttttgccgtgttggctcaagcgatgtgcctgtcttggcctcccaaagtgtttggattatgggtgtgagctaccgtgtcccctcactccctgcctttttttttttttttaaataaagaaatggagttttgctatgtttcctaggctagagtacagtggttatacacaggcacaatgctagcacaccgcagccttgaactcctgggctcagggatccttgtgcctcagcttccagaatagctgtaactacaagcatgattttatttatttatttatttttttggtacagagtcttgcacctgtcccccaggctggagtgcaatggtgtgatctcggctcactgcaacctctgcctcccgggttcaagcaattctgcctcagcctcccgagtagctgggattacaggcacgcaccactacgcctggctaatttttgtatttttagtagaaacagggcttctccatgttggtcaggttagtctcaaactcctgacctcaggtgatttacccatctttgcctcccaaagtgctggcattacaggcgtgagccactgcgcccggcccatgatttttattttctgcgaaagagccaggaataacaagattcttcttagatttacacataaatttctcatctcatgcttaaaataactgtcaaaagatttgtttttactttatttgacaaaattttatatgtttatcatgcacaacgttttgaaataacatatgttgtggaatgactaaattgagctaattaacacttggtgtattactttacatacttattttttgttgttgtgagaacaccctagattttaagtggagattttctcttagttattttcaagaatatagtacacttactaactgtatcaccatgttgcacgacgtgttttaccttttttttggtcttttttttttttcctttttgtggagaacggggtctcactattttgcccaggcagatctcgatctcctgggctcaatctgtcctcctgcctgtgcctccctaagagctggaattacaggcgtgagccaccgtgcccagctgtttttacttttaaaggattctttaatagcattgttcacctataagtcagtctgtatttgtgaaaggcattggttttgaggatcaccgaaccacatgaacccgaatggataactatccaggattttatgctctttaagtcaaaagcatattgaggtggccattttgttttcaggatagtcttttttgtaagtttatatggaccaacctgataccacattccttttgaaaataagatagtatttatcagtatttcactttcatttgtcttatatttccacttatgttaattatgagtaaggatacttaattgtgtggcatgttgttgatagagaatgcagtcatgtaaaatcagtgtggtttttcttttcttagggaccccaatgattcctgtaccaatgagcattatggctcctgctccaactgtaagtataacttaaaggaggaatcatgagttatggtagtgctagtgcttttaagctgaacagcatgataaacttagataaattatgagtatttaaaagaataacaaggacagaatgacagcacccctgtagagcatatcatttatttgaataagtatcattttcacttaggtgtgcatatatgcagttgcccttgcaatgtgctccctaagtagataattctatgattttcctgttactatctagactcttcatatacttgttattacaaatttaggactttggctcttcattgccttctcatcttggtcctgggagatgggagaaggatgtgacatgtctgatctcttaaaagaacataggaatccttgtaaaaattaaaattttgaaatgaaatttgtgtggactaccttttacatgtttcctcctaccttcctaaggtatatggcctaaggcataaattttaaatgttcaagacataggccaggatcacctgaggccaggagttcaagactagcctggccaacatggtgaaaccctgtgtctactaaaaatacaaaaaattatctaggcttggtggtgcgcgcctgtaatctcagctactcgggaggccgaggcaggagagtcccttgaacccaggaggcggaggttgcagtgagccgagattatgccactgcactccagcctgggcgacagagcgaaattccgtttcagaaaataaaagtaaaaattatgtcttaaacataacaaagttttcttggttatttttgtttcttttttaagaagaaaggtaatctagtagtagaagtttacttgtcacaaataagtttgcattaatgaaatgtgctatgcactttaggagctttagaagtatacaagcatgcagagcttaaataatgtgctatatatatttatttaatcctgatgtttttagcctaatgttaattgtggtaggaaatttaattgctggatcaatttttattttgtttcttcaccttaggtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctgtaagttaaactgtttatttttcattaaaaatttttttatcattctacatttcaaacttaagcagaaagaagactttcagtgattgctttttattttaaaaaatttcagtcctgcagcaaaggtgaaaaagtacagtgaacacgtttgtattcttttcctagattcaccaatgaacatgtttagatattttatgtacacatgtgtaccacacacacttttttcttggataatttgaaagtaaattgtggcataacatttcacctgtgaatccttcatttatctcctaagagcaaggacattctgcgacataatcacaatgccactatcacacatgaaatttggccgggtgcagtggcttttgcctgtggttgtcatcctagtcctttgcaaggctgaggcaggaggatctcttaagctaggagttcgagaccagcctgggcaacatatcgagacacatctttacaaaaaattaaaaaataatagggccagatgcagtggctcatgcctgtaatcccagcacttcaggaggccgaggtgggcagatcatttgtggtcaggagttcgagaccagcctgaccaacatggtgagaccctgtctctacaaaaaatacaaaaattagccaggcgtggtggcgtgtgcctgtaatctcagctactcgggtggctgaagcaggagaatcccttgaacccgtgagatggaggctgcagtgagctgaggtcgcgctactgcactccaccctgggcgacagagcgagactccatctcaaaaaaataatgacagggattaaaaaataaaaataaaaaaaaagccaggtgtggtgatgcacgcctgtagtcctagctgttcagaatccgaggtgggagaattgcttgagtctaggagttgaaggctgcagtgagctatgatcttgtaattgcactccagcccgagcaagagagtctctaaaacaaaaaaatatataaaattgatataatattgttaactaatgcacatgtagttcatatttaattttcccagtaatggccataatattaatagttgttttatttttcatccatgatccaatgaaagatttttatttacttttgagacagatttgctctgtcacacaggctgaatgaagtggtgacatcttggctcactgcaaactctgcctcctgtatttaagtgattctcatgcctcagcctccctagtagctgggattacaggcgcgtgccatgacacctggctcatttttgtgtttttttagagacaaggtttcatcatgttatccagacttgtcttgaactcctggcctcaagcaaaccgcctgcgttggctttccaaagtgttgagattacacgcgtgggccaccacacctggctagggttaatattttgagactgtgagtccttttccccaatgatgttaaacaatgattttagcatccaatgatgattgactgattccttttaaagttttattctgagcttgaatagtaataagttgtttaaatttggtaagcttgttgattcactttttttacctttttaagattttatcttgatgatacatgtacattgttaagtgaaataatgctgaatgattgtataataaaataaggccaggtgcggtgtctcacacctgtaatcccggcactttgcggggccaaggtgagtggatcacttgaggtcaggagtttgagaccagcctgatcaacatggtgaaaccccatctctactaaaaatacaaaaattaaccaggcgtggttgtcggtgcctgcaatcccaactacgcgggaggctgaggcaggagaatcatttgaacctgggaggcggaggttgcagtgagttgagatggcgccactgcactccagcctgggtgacaatgttagactttgtctcacacacaaaaaaaggagtttggaagaatgactatattctgcactgagaggatctgcaaagatgtcattcttcgtctgtatcccagaatcttgtgtaggttctctgtaaggacagggccagggttatctcaacctgtggttcacctcatgagtagttcagtatgagtcctgcaatcttgccatcctctggaaatattgttgcctgctctccttatgcccctctgagatgctgggcaattactttacatcattcatgattcttgttcctcaactattcatatttaagaaattcctgttcttttagaagactggatctcctgggcactctgtaagttttaattaactggtttgaggatgttttgggtttctcagttttgttttcttctattacttccatgggatttttggtaatttcagtctgaagcctgactccatttttattcttgagttttctcctgggcttcttttcactgtagccacaaggcctaatctgaggtctgcagagaactagcacttactctgctctaatggaattcaggaaagtcagaaggtactggagtatagaaatgtgtttgctcctgtctgcttctggaagtctctgttttgctatgttattactgctaatgttttctccctaggtgtatgtgaaaagattctcatcacaaattctcatagaagtgccgtttctgagtcttagggcatgcttatctgcagctttacaagataattccacaccaatttatttatatttactgcagcagtgtcatgtccgagtttctattcttacacatcttttttttttttttttttttttttttttgagatggagtcttgctctgtcgcccaggctgtagtgcagtggcaccatcttggctcactgcaagctccgcctcctgggttcatgacattctcctgcctcagcttcccaagtagctgggactacaggcgcccgccaccatgcccggctaattttttgtatttttagtagagacaaggtttcaccatgttagccaggatggtctcgatctcctgacctcgtgatctgcccgctttggcctcccaaagtgctgggattacaggcgtgagccaccgcgcccggccctcttacacatcttttttaacaattggtgtttatttagaattttacattgtgttgtgaaataccttattcctatttcaatatgcctttttactgttcttcataattttgatattatctgttgacatgttatggtagcttgaggcctaaactgttaaaggcctcagtctcccttccctacttccttacaggtgttacaagatggcgaacttgataataagtattattatgtaaatagttttagcagaactaggttatgtgctatgattgtattttctttctttggtttgttttctttctttctttttttttttttttatttgagatggagtctcactctgttatccaggctggagtgcagtggcgtgatctcagctcactgcaacctcgccatccggggttcaagcaattctcctgccttagcctcccgagtagctgggattatggatgcctgctaccacacctggctaatttttgtattttcagtagagacggggtttcaccaggtttgccaggctggtctggtactcctgacctccagtgatctccctgcctcagcctcccaaagtgctgggattacatgcgtgagccactgcctagtccattttcttattttaattttttattttttatctttgagacagagtctcgctctgttgcccaggctggagtgcagtggcacgatctcagctcactgcaacctccgcctcccgggtcagtgattcttctgcctcagcctcccaagtagctgggatttcaggcacccgccaccacgtccggctaatttttgtatttttagtagagatggggttttaccatgttggccagactggtctcgaacttttgacctcaagtgatccacccaccttggcttcccaaagtgtggggattcttttcccttcttttctagagctcctcctgtcaggtccctttgttcgtctcatgtgttctggttcctctaagtctacttttatccttggatttttttctgtcttttctagtattccccttattgctgttctgtgttgggtggtttggatcctatatcttgcttgtgccgacacatagtagttcctgttatattgggatgatacatcctctgtatatgatgtacatggtatatatgggtatgtggttggtaacttttctgaatctaaatctgaagtgctttttatttcatgtggtcagtagtttaccgggatatagaattcggtgatgaagcttatcttcctcacattgaaggtgctgccttatcgtgttatagcatctaatgatggttttcagaagtcccgcatcattctgaatgctctttgtgtgtgaactgtttttccctggaatgcctctcctagtgaggatttgactgattggaggttttagttcctaattatgtgaaattcttcgaatgtttatttgattttcttatttttcttatatcattgtgttggtcacttacttggtgggccatttcgttctggagccttttttcaggagaaaattttgagctatttgagaattctttttactttcttcaggaactctgtttggatgttgagcttccaggtttgacctatgtgtttttgatttcctattttccatctcttactattttgcacgggttcttgggatttgtccttaactttaccttccagacttacattgaaatatttatttttaatgccatgtttcaagtttccattagttttctcttgttctctgaagatttctcacctacaccctcctccttctgtcttttttttaactggatggaactttattttatttttcttttttgagacagtctcattctgttgctcagactggagcatagtggcatgattacagctcactgcagcctcgatttcctgggctctagccatccatccgtctcatcctcctgagtagctgggaccactggtgtgtgccaccacgcccgcctaatttttttgtttttgtagagacagtgtctccctatgttgcccaggctggtcttgaactcctgggctcaagcaatccttccacatcagcctcccaaagtgttgggattatagacgtgagctacacctcgctgcttttatttttaaagtataatagtgtcctaccgttcagataacctgccctccttcacattttggaatatttctctttatttttacagaaagctgtttttgtttatagttagagtcttgctgtgtatctgcattttcttttcccaagttatttttgcataccgtatcaagcgttttcccatgttaatgggatggctgggcgcagtggctcgtgcctgtaatcccagcactttgggaggctgaggcgggcagatcacgaggtcaggagttcaagaccagcctggctaatatggtgaaaccccgtctctactaaaaataaataaaaaaaaaaaaacaaaaaacaattatccaggcgtggtggtgcctgcatgtagtcccagctacttaggaggctgaggcagaagaatcgcttgaatctgggaggcagaggttgcagtgacccaagatcacgccactgcactccagcctgggtgacagagcgagactccgtctcaaaagaaaaaaaaatcctttataaatacatacatattgtttcaaaacatttctttatagattcataatatttacttaaatttattatagtttgttttaaccattctaattttaggcatttaggtttacgtgtttattttgttaggataagtagtgatgcgaaacttttaataaaaggtaaacaatgttctgcaaatgaagaatcagtaagaatttatatttttctttaaatgatttgttgttcatttctttcatgtgataagtttgtgggaattgcaaaaattttcgcaaatgtagttgctggttttttattttatgttttttatccctagtagaaatataattttgcttttagttacattaaaaattattttgttaaatggtagcaatctgtttgttttgttttctttttaagaaatgtggtttggttttgagctggaagagagtacaaggtgcttccggaaagcttcaaggtatgtcatttttttccttatttgctgaaatcactttaactaacctgtgtgcttaaatcactttgcatgacttaactctcattgtctttatcagtaagacttattttattagcactctttgtcctcttttttattgaaatagggttaaaaggcagtttgggaaaatattggctgagaattgagatcagaaggaggaaaaaggtgtaagaggaaaggaaaaaattaaaattgctcaatttaactggtttcttgttctttcaaaagtctcttttgtctcaagaaatgactgcatgatcaaaatggaacaattagtaagggagaagaagagacaatcatggcctgttaactttttttttttttttttgagacctagtctcactctgtcacccaggctggagtgcagtggcgtgatcttggctcactgcaacctctgcctcctgggttggagcagttctcctgcttcagcctcctgagtagctgggattacaggtgtgcgccaccatgcccggctaatttttgtatttttagtagagacggggtttcaccatgttggccaggctggtctcaaactcctgacctcagatgatccacccgccttgacctcctaaaatgctggcattacaggcaggagccaccacacctgacctcaaatgttaattttttaaatagttgatttgattcaggttctatatgaagtccacacattgcaactagttggcaatttgttttaagtctcctaattttttttattagcaccatcctctaaccaactgagctaactggccagactcttaatattttaagttattctatttctaattttccttgcagtttatttgttgaagaaactgggtcatttgtgcaatagtattttttaagttgagttttgctgaatgcagctccagtactataatttgccattaatctatcctctgtgttttctgtaaagtggtcagtagttgtacttgatgtgtgctgtgtggtggtttgttttgttttgtttgtgttttttatttttttggaggagtttcgctcttcttgcccaggctggagtgcagtggtgcgatcttggctcactgcaacttccacctcccaggttcaagcaattctcctgccccagcctcccgagaagctgggattacaggcacgtgccaccatgcccggctaattttttatttttagtagagacggggtttctccatgttggtcaggctgctcctgagctgctaaccttatgatccgcccacctcagcctcccaaagtactgagattataggcacgagccactgctcctggccgctatttttttttttaatgtttttattctagcaccttatagcaagaatactataaaggtagtattcttccatcagggaacacatgtgagattgtcttttttgtatgtgtaatagcatcagtgttgccagtgcctagattgattaattcattaggaagtaattcatcagtagtcttttttcttttttttgagacagagtcttgttatgttgccaggctggagtgcagtggcataatcttggctcactgcaatctccaactccctgattcaaacgattctccagcctcagcctcccgagtagctaggattacaagcatgtaccaccccacccagctaatttttgtacttttagtagagacagggtttcaccgtgttggccaggagggtctcgatctcctgatctcgtgatctgcccgccttggcctcccaaagtgctgggattacagacgtgagccaccgcgcccggcctcatcagtagtctgttttgaagaattctgtcattcttttattgaggaacaaatctttttcatatattagtagaatgcttctctatggagaaagttgcccctgcatctactgtttggtaacttagaggcatttttgttgttcttgagatggagtttttcgctcttgttgcccagactggagtgcgatggcaccatctcagctcgctgcaacctccgcctcctgggttcaagtggttctcttgcctcagcctcctgagtagccaggattacaggcgcccaccaccatgcctggctaattttttggtttttttaatagaggcgggattttgccctggttgccaggcaagtcttgaacacgtgacttcaggtgatccgcccacctcagtctcccaaagtgctgggattacaggcttgagccaccatgcctggcatagaggcatatttaatacagaataggcaggatagatgcactggcttgctttcttaaaacaatgagttgctatcctcagcattctctagcagtgactgattttcttttttcttttgaattattgtgaacttaggaattgaagcatatttagtgttattgtatttaatatggattcattgtagttattatcaccattaaagcttaacttaaattgtctctgcactttacatctccagtggttttgacatgaccctgaacacctttgacagctgctttgttatctggtatgacaatttgttctaaggtcatctagtataataggttttcggccccagacttagaatcagccatttctccaggggaaattgttttgaagatcacgatctggacactaggtgcactcatattaacagtggtttgggatgggtgtggtggctcgagcttgtaatcccagcactttgggaggctgaggcaggcgggtcaagagatcaagaccatcctggccaacatggtgaaaccctgtctctactaaaaatacagaaattagctgagtgtggtggtgcgctcctttagtctgagctactcaggaggctgaggcaggagaatcgcttcaacccgggaggcagagtttgcagtgagccgagattgcaccactacactccagcctggtgacagcgcgagactccgtctaaaaaaaaaaaaaaacaaaacagtggtttggtgtttgcttttaggtttttccagtgtatactaattcagattcaggactaaaaggtttttatttagcctgttttgtcatatatttgtatctcctttttccccacactgaggtccccgagtttcaaggccattggggatgataaactattaattactgagttgctttatcttgcattgcacatataacagtttcacactaacaacattgacactatcatcagcaatatgatcatttaaaattacttttctttttttttgagacagggtctctgtctgttgcccaggctggagtgcagtggggcaatctcagcttactgcaacttctgcctcccgggttcaagcaattctccttccttagcctccctagtagctgggactacaggcatgtgccaccacacccagctagtttttgtatttttagtagagagagggtttcaccatgttggccaggctggtctggaactcctgatctcaggtgatctgcccgcctctgcctcccagagtgctgggattacaggcatgagccactgcgcccggcctaaaggtacttttttgaggggcatatctgtttgtctttatggtatatcacactgaaatgtcaaatttactattttaatatcagtagtttttttctgtttcctgtcattatatacatatttagatttatttgattttattttcaatttgttggttgctcttcttagatttaattttgttttaatatttctgttaaagtcatcttaatagtgagattgactagttataaaaggaaatagatgtaagtaaaatagactggtaactaggatacaaattctgtaatttaacatctcagaattgaaaagtgcattgtttgtgttcctgcagtctgttctttcttgtggctgtttggaagtctagatagggtgaatttatgaaataattgactcctttctttttttttttttttttgagacggagtctcgctctttcgcccaggccggactgcagtggcgctatctcggctcactgcaacctccgcctcctgggttcacgccatactcctgcctcagcctcccaagtagctgggactacaggcgcccgccaccgcgcccggctaattttttgtatttttagtagagacggggtttcactgtgttggccagaatggtctcgatctcctgacctcgtgatccacccgcctcggcctcccaaagtgctgggattacaggcatgagccaccgcgcccggccaattgactccttttaatcatgaatttcattgactctgctaaatattttattagagcttctaatgagtagcagtttgtctgatttgaatttttcttcctctctgtttttccctttttttcccctttggttgtttgaggatactaaaagtgaaatggttatcaaagggaattggtggacaggggtggaattatgaattgagtggtctttgtattaaaacatttggactctagtgattctacttttccataattttttttcttttgtaagtgaattggtatttcactaattgttttcatccattgctagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatggggtatgttttctgtcgtgttatcttttctaggccagactgtgctatttcagtgtagtgcttctcattataaatgaatctaatatggggcttcaaaagatcatcatgtatgtgcttgtggcttaatgtaggagggtattttatagtttgtagttattttaagtcttatctgcccatagtgggtggatgactgttggtttgcttgttccaggttgggatgaaagtagtaagggaggctggacaaggttaacttgccagagaaagcactggtacagactattccaaacagagctaattcattaaggcagctttgtaagtaagtacaaaatatatttcaacctacacaatttttattagtttccctctcttttagaagtacaccgactctaaaatgaatgaaagtctgattacttgccttaggttgggggctttatccaagctctactaagtgaagctaaaataaaggacattgttgtatattgtattttaatgtatacattattacctcctcagcaaagtgaaacatagctaaaacttgagtatatatttccttcatttctcttcttagttcctttttggcatctcatgctgaacaaatccaaaatagatttattaatgccttcccccaacacaaacaaaaccagaagagtctttcgctgtcgtcaaatttttattatctttcaaaatagaaatcgctttttgctgggcacggtggctcacgcctgtaatcccagaactttgggaggcagaggcgggcagatcacctgaggtcaggagttcgagaccagcctggccaacgtggcgaaaccctgtctctactaaaaatacaaaaaattagcctagcgttgtggtgggtgcctgtaatcccagcaactcagaggctgaggcaggagaatcgcttgaactgcagaggcggaggttgcagtgagctgggatctagccattgtactccagcctgggcaactagagtgaaactctgtctccctgctgccaaaaaagaaaaaagaaatacctttcatgttccctccaagttctttgttaaaaaaaaataaaaaccaaacccaaaaaactcacaaaatgaagcaaagtataaataatcaattaaataccacctgtaatcccatcatcataagcaacactgtaggcggtttggatgtatgttcttccagacatttttctgtgtatgaatgtggttcatttgttttttgttttttttgagacagagtctctctgtcgttcaggctagagtgcagtggtgcgatcttggctcactgcaacctctgcctcccgtgttcaggtgattctcctgcctcagcctcctgagtagctgggattacaggcatccaccaccacgttcagcaaatttttgtatttttagtagagatggggtttcatcatgttggccaggctggtctcgaactcctgacttcaggtaatctgttctccttggcctcccaaagtgctgggattacaggtgtgagccaccacacctggccaaatgtagggttttgtttgtttgtttgtttgaaatggagtttccctctcttgcccaggctggagtgcagtggtgcgaccttagctcactgcaacctccacctcccaggttcaagtgattctccctcctcagcctcccaagtagctgggattacaggtgtccgccaccaggctcggctactttttgtattttcactatgtaagtgaggctggtcttgaactcctcaccttaggtgatctgtctgcctcagcctcccaaagtgctgggattacgtgtgagccactccacccggtcagcattgcctgtatttctaaaacataagtataattttatgaaactcttgcttatattatgtgagacccatccttaatggttttggatttcttacagaaaaaagtaccccccctctttttttttgatgcagtctcgctttgttgcccagactggagtgcagtggcgaaatcttggctcactgcaacctccacctcccaggttcaagcgattctcctgctttggcctaccgagtagctgagattttaggcacccgccaccacccccagctaatttttatgtttttagtagaggtgggatttctccatgtcttccaggctggtcttgagctcctgacctcaggtgatccacccacctcggcctctcaaagtgctgggattacaggcgtgagccaccgtgcccggccataaagtccatatttttaggatgacattcaaggctcactccagtccacgtttctagcttccgtcttccctcccctgcacatactactgcatgtacctccacagtcttcccttttgctttgctggcatctcatgtctttgttgcctatccaagctccctgttgaaattctatccatacttataattaacatgtcccttgattcatacagactttatcagcctgcccttagtttctgtcagacagaattaagtcctctgttcccatataaagcagatctttatagctgttttagtagatattgtttatatatctctctctttcacagccccttgtaacccatctcattcccatattctctttcaacccccatctctgattacagatagaaagggtgataagtttgtgggctgtgtctctttaatcttgtacctccacagcatctaggacagtgtcttgcctaaagcaaggatggaattaacatttgttaatagacgcttatctgtcagtcttactatcctcaccctgcttcataaggaaattatattttatttatattttatttcaaatcagtaatactgcctgtcacatcactaaaacctcaaaaaacagaaatgtttgaaataagaattttcaggtttgccttgtgataactgtatactaactagttgaaagtatggattcagtatcttcaaagtgttctgatttgctaggactcactgttttcttgtgtttaatcttcagtttgtgaggtcatttaatttgtagcatttgcaaatgttatactgaaaaactctgagaatgaaataagtcactatactacgtatttttataaataaggaagtgcacaattatgtgacttcacatttcttgcttgcttgctttttttggggtggggacagagtgttgctctgtcacccaggctcgagtgtggggtggtgtgatctctgctcactgcaacctcctattcccaggctccagtgatccttctgcctcagctgggactacaggtatgcaccaccatactggctaagttttatattttttgttgagatgaagtttcactgtgttgtccaggctggtcttgaactcctgggcttaagtgatccacctacttcagccttccaaagtgctgggattacaggcaggagccactgtgtccagcttacattttttgtataatcaacattagccagagtaaccacactttagatctgttggtcttcaggaaaagcaatatgtgtctggatgtggtggctcacacctgtaatcccaacactttgggaggccgaggtcggaggatcacctgaggtcaggagtttgaaaccagcctggccaacatggtggaactccatctctactaaaaaaaaaatacaaaaattagccggatgtggtggtgcacacctgtaatcccagctacttgggaggctgagacaggaaaatcacttaaaacccaggaggcggaggttacagttagctgagattgcgccactgcagtccagcctgggtgacagagtgagactctgtctcaaaaaaaaagcgaagttacatgcaataaaatcacacagaaaaattatttttaataaaaaattaaaacaattgacagatatcagttatatgatttattgttccaactgttatatgtgtatttctgagtgccctttggcttcttgcccggtggtacttgaagtcataggataaacatggcatattttccttaagtgtcaatattactcaacaaatataggttaaaaaagcattctatctgatgtaaaaaaaaattttcaaataacttaagcaaatattactatatagtggagtagattagagatttgccatgattttttttttaagggtggtggggggtgtagggagagatgaaagtcggagagtgagagattggagggagggagcagggggaggggagaagatggtgggggtgagatgggtggctactgccgccatgatttttcagtataaaaatatgacatggtgattgttttttattcttggtcgttgattagttggagaaatttagaaagctgttaagtagaggataggagaatgagacattgaaaaccctttgtgttgctttattaggcattttcctctgaggcagaagagaaaacaattagttccttatttctcattgactaaaaaggaaacatgagtttgtctaggggagcaacatatttttcatgatccagaatttttttttaaattttcttgcctttttttttttttaattaagttttagggtacatgttcaccacgtgcaggtttgttacgtatatatacatgtgccatgttggtgtgctgcacccattaactcgtcatttaacattaggtatatctcctaatcctatccctcccacctgccccccaaaattttcttttttttatgagatggggtctcgcgttgttgcccaggctggtgtcgaactcctgggctcaagcagttctcctgcttcggcctcccaaagtgctgggtttacaggcatgagccactgtgcccagccagattcagaattttaagaagaattttgcgcatgtgtaaggtgtcttgtcaaacaacttgactgaacattttaatttagattttgcagaatttgcaggtgtaactttttttctttccatttcttattgacctctagtagtaaagtattccatgtgaggtggccatgctaatttagttcatgtcctattgctttctggctgtccagcaaaaatagtataggagacaatatatctgcttgtatgtcacaagtcatagttattaaccatatattcaagaatgaacactgacaagtgctggaaaaacagttattctctggaaagaacctatttaatagaggacagctgcttcaggggaacatctttggaaattagcctggctgagtacattttctcaaaagaaagaactctgcatttccttaaattttttaaaaggttcgtactttggattctagacctcagtgccaaagaatgagcccagcagagctgtttaacttcacagctactagctttactattgaaattttaatttctctgaaaagaaccaactaggtgggccatgtaaacattacagataatctgtcagcttcctatatggctgaatccttcaccttttgtttcccagtattactgattatgctttctggtttctccctctctgcccaccgaagtctcactcttgtcgcccaggctggagtgcaatggtgtaatctcggctcactgcaacctccgcctcctgggttcaagcgattctcctgcctcaacctcttgagtagctgggagtacaggcacccgccaccacgcctggctaattttttgtatttttagtaaagatgggtttcgccatgttggctaggctggtctcaaactctggacctcaggtggtccacccgcctcggcctcccaaagtgttggggttataggtgtgagccaccgcacccggccatctggtttctgaagtataagaaaaaaacaggaaatcagaaaatcgtgtatagttgatattccagagatagagctttagatgaaacttgccagtctgtggagtggtctttctaacctgatcatctaccatgatcaggttttgttttttttttttttttttcttgagacagagtctcactctgtcgcccaggctggagtgcagtggcgcgatctcagctcactgcaagctccgcctcccgggttcacgccattctcctgcctcagcctcccgagtagctgggactacaggtgcccgccaccacgcctggctaattttttttgtatttttggtagagacggggtttcactgtgttagccaggatggtctcgatctcctgaccttgtgatctgcctgcctcggcctcccaaagtgctgggattataggtgtgagccactgcatccggcctaggttttttgttgttgttgttattgttttttttttaaatattagcaatcagttaagatttttgggttaataaacttttcttctaaaaatgtgaattagttaattccaaatgctttatctctaatagtaaaatagccatattgatatttaaattttggtttacagtggaaacaataatcaatttagggtctataaggattttttttgtcttttgagacggagtcttgctctgtcgcccaggctggagtgcagtggcgtgatattggctcactgcaatctctgcctcccgggttcaagccattctcctgcctcggcctcccaagtagctgggaccatgcccggctaattttttgtgtttttagtagagacggggtttcaccatgttagccaggatggtctccatctcctgacttagtgagccgctgcacgcggctggggaatttttgtatttttttagtagagacggggtttcaccatgttggtcaggctggtctcgaactcctgaccttgtgatccgcccgcctcagcctcccaaaatgctgggattacaggagcgaggtgtgtgtgtgtgtgtgtgtgtgtgtgtgtgtctgtgtgtgtgtgtgtgtttttgatgggggtggagacagagtctcgctctgtctcccaggctggaatggagcagcatgatctctgctcactgcagtctccacctcctgggttcaagcaattctcttgcctcagcctcctgaatagctgagattacaggcacatgtcaccatgcccagctaattttttgtatttttggtagatggggtttcaccatgctggccaggcaggtctcgaactcctgacctcgtcatctgcccaccttggcctcccaaagcgctgggttgcaggcgtgagccaccgagccctgccaagtggttagttttgtaataacatgtaatgccttatatttaagttatctgtgtcataacccatctgttactctgtagtgatacagcttgaggagaagagagcgtttttcaatttggattttattccgtctaagtgcagcatctttctcacagtatgctcttaagaatttgttgatgggtgtggtcgtcacgcctgtaatcccagcactttgggaggctgaggcgggcggatcatgaggtcaggagatcgagaccatcctggctaacacggtgaaacccccatctctactaaaaatacaaaaaaattagtcgggtgtggtggcgggagcctgtggtcccagctactcaggaggctaaggcaggagaatggtgtgaaactgggaggccagagcttgcagtgagctgagatcacgccactgcattccagcctgggcaacagagcaagactccgcctcaaaaaaaaaaaaagaatttgttgagcaaattaatttaagaaataaaatgtttgttgaatacgtatccattggagacagctttcagaatgcttgtggtcaacttataaagttactgctaagttacattgttaaggaggcacaaggcatgaaactcaccttgaatagagttgcaggaattatgaccaagagccaggcatgtatgcacatgagcatggttcttgtatgtatctgaaaatgtgcacggtatatgtttaccaagtaagtcgttaaaaactttggggcatgcacaactattgtagcacaactattgtagcacattagaagccaacaattttccccacatagagggaataatctagacttcttagaaaataataattattattattgagatggagtttcgctcttttgcccaggctggagtgcagtggcgtaatctctgctcactgcaaccactgccttccggttttaagcgattctcctgcctcagcctcccgaggagctggaattataggcatgcaccaccgcactcggctaatttttgtatttttagtagagtggggtttcaccatgttggccaggctggtcttgaactcctgacctcatgatccgcccccgcctcggcctcccatagtgctgggattacaggagtgagccactgcgcctggccagaaaattattgataaagacctacaaatacttactttgattccttgttagggttgtaagtgtatggtttctataagtggtatgtattcctgcattataagcactcgtagaaagcaaataggaaataagccatcattacagcccctaaactcccgattcttgcagtttggtatatttagcaatctgatgtttttgtttgtttgtttaatctacatacaattttgctttttctgagtggtagctatcacaattaacttaaaattgtattttgcctttactacgtaactgaattttcaactgtttaaaagagtcgttactatttgtgtacctattgagcaaaacagtctgaaaacttgtgaatggtttgcagatgtgtcgtatagtgtgctagtcctgaaatttagggaccagaattttttagctattaagaaaaagaaaatgaaaatgaagtagtatctcaggaatagttaaataaaaaaatgaagcttttctgatgttaagaacaaaaccaattctgtgtttaataggactacagagatgtttttgagaaaacatgtatgtttattaactcttgttgtagagtgattttgattttcttgcttgatttttctttcccctgaatttgctgttttgtttaagaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacgtatgtgttctgacaacaacatatcatttctaccgtttgttttttatgatatcactcttatactttgattacatgtcagttttcttttttcttttcttttttttttttttttttttttgagatggaggctcactttgtctcccaggctggaatgcagtggtgcaatctcagttcactgtaacctccgcctccggggttcgagcgattctactgcctcagcctcctgagtagctgggactacaggcatccgccaccatgcccggctaattttttggtttttagtagagacggggtttcaccgtgttagccaggatggtctcaatctcgtgacctcgtggtcgacccgcctcggcctcccacagtgctgggattacaggcgtgagccaccgtgcccggccacattttaaacttttttacagagacaaggtctcactatgttttctaggctggtctccaactcctgggttcaggttatcctcctgcctccgcttcctaaagtgccaggattacagtcatgagccactgcgcccggcccctattttactttgtttgcctatggttgttctgtctctgttctaagcaagaaaccagatctgattcactgaagatttccacccactcttaatttttagctgcctttccttaagaaactatgtcacattcccctccctgaacaataatggtattgaataatcaaactggaggattctgaaagagcagtacaacttgaaacattcctcctcagtgaattgattgctacctctttgtggccctaagctaattgtccaggttgaaagaaaaggtttagttttctcatacttatttcctttggataaacttagataaattataggaagtgttcttttaaaaatactggaagaagccagaagtggtggctgacacatgtagtcccagcaacttgggaggctgaggggagaattacttgagcccatgaacttgagtctagcctgggccacagagcgagacccttctataaagtaagaaaaaaaatcccacaaatattggaagtgttttatttatgtttttgagacagtatcttgctctgtcacacagactggaggatggtggcgcaattacggctcactgcagccttgaatacccatcctaaagtgatcctcatgtgttagcctcctgagaagctgagactataggcatgtgctaccatacccagctaatttttgtattttttgtagagacagggtttcaccatgttgcccaagctggtgttgaactcctgagctcaaatgatctgcctgcctcagccttccaaagtgctgggactacaagtgtgaatcactcatagctggctcaacgtgttttatatgcatgcattatgtaataaaaaagtactacgtggtatatatattatgattagttatgaatggatggttacattttatattattttaaatttcagtgcctttttaggccatattcagttttctttgtggccagatacatacatttttattatttggtatgtgtttcctcgtttggtcatagaacttttcttttttgttcccgcccctacccccacccaagacggagtctcactcacttgcccaggctggagtgcagcagctgcgatctcagctcactgcaagctctgcctcccgggttcaagcgattctcctgcctcagcctcctgagtagctgggactacacgtgcctgctgccacgcccagctacttttttgtatttttaatagagatgggtttcactgtgttagccaggatggtctcgatctgctgacctcgtgatccgcgtgagccaccgtgcccgacccataacttttctaaggaggtgtattctgttaggaatggtaattggtagggtcagtaaggtacagggtaattgaggcctgtagaattcattcttcctctttcttcattagtgggaaaggagaaaaataacatatttgtttgatgtggattgggaggagataataaattcttcctctgtggcaggagttatgggtaaatattgttggtatgattagaaagccctgctactatgagagcaccttctatatttccatttcttgggggtgttggagtatccagagaggagggtagtgtgtgatcagttattgtaaaaagagtgaaatcacttctattcccaagtaatttgaaatcaagaaagcatcacagaagtgtactgtattgttcacgtcataaatgtatagggcattgctttgcagattagtatgagctctgtttttcttttttaaaaaagattcttggtggattttttcacagattttccgcagatttccagtggccccactgatcccttatccactcatcactaaggttagtttaaattgtaggctttgacaatacctgtgtttactgctgattgttgatttgtcattcttgtctatctgatttttcactatttaactttagattgttagatttgttattgtggatattctgtttacttatttactctttgagacctatacagaatatctaacctttaactgtttatattgaagtagggtgttctttattcattccctcctgtgcccgttttcttttaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagacttaaattagattcagggggcagcaggataacatacactgtagtgtatttctgggggcagttatttaacttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaaccaaaacagttgttttttattgggtggtttggctaaaagggttgtttgaaactccagtaacaaaaaatgagctcagtgaacctttgcatgttttggtatgagtttattaaataaccacagactgtcagggtatcagcgtggcagggggcgtccatttacagcacggatgagtctgaagagagaataaggtaagatttatgattttttaatctgtcctttcctcttcatgactttcttacataattttagactcacctcatttcccttctccagtctttctttaaaaatatacatgtatgtttacatgtatacctgtatttgtatacatgtgtgtatatatatatatatatatatctcatatataaacttcaggaaacatttagtatggactagattcactcactttttcatttacttagaaccaaacttttgaaatgagttctgaaacaaatggttatttatataactgaatataaggagcacagtgaaataagcaagaattaaaaattgaggaattctacaggaaaaattagtattggaacagctaaaatattctgtaagtatctatttcagaaataaacaaatttctttataagtgtatgccattgaggtaagttttatatagtctagcctcattttacaatataaatttttatattcattggaactgtttcagaaatgagatttttccccctttaatagctgttagtttctgtcctctttctatcatatcttatttcatccctttgtaatttcaatgtattcagttttgactttgcccgtattctacttcgatatagactggcacagcaactgaatatattgctcatacattagctttcctttcataacctgctataagttctctgatccatgaggaagagaaaaagagtatctgacaggtaagattgctttttaaagttgttttaaatgcattacatgactgagaaaagaaaaatgcacattttattgttgcagtttaaaatttcattttggtgaaactaaacgtgaaacaaaagggataaatgtgttttgttttgttttgttttacctgtttggggtatttttttctgagtttgtgtagaaaccgtgtggtacactggtaatcttgtcagggtacaaacttggtctgactttgttatttggtttatttgtgaaccatgtacttgctcttcctcccagaaacatagcttgtaggcaaggttaatccagtgttggcgatccatgtcctagcacagcatctgtaagttaatgcacaatcgttccttccaaggatggatttatcattgtaaatatattttcattgtcttacaggcataatgggcataagtatgttgcttttaaatattttaaattaaactattacagttacatatattttgcttgaagtgagtgattttcaaactttttgtatttggtgggctgtccatcttgtaatggtgggagtaaatgtttccatagatgataaggcagttcttggctgaattcagcttgtgtttcttttggagggtgggcaaatcagagggcagagattatttagttgcattataggtattcttctataccacttgccctttgaaaccctcaacttgaggtaatgtgcagtctggggttttaattagtattaataatcttgtggatttacagaaatctataatgcacagagttgagttttaaccaatgatcgtattcatagaaaatatttcgaaccaccacattcttcatggtcattttagttagtacatagtcattgagtggccagccacacctgacacaatctcccagcatccaagattggagattcctggtctgtgtagagtatatggttttgcacgaaatctttctagtcttgtgattgcttcagtttaatttgtcacataaaaccacaagtatttaatattaatgtatcagtggtttggtgtttttgttcccagtactgggctttgcgccgggaaaaatctgaatactggagctacagagttaactctaaaagtgcttttattggtttctagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaaggtaaggctttacagaagttactgtttcctgatagctttaagaaaactatcgggtagtcctccagagtaccatttgcattcatggaatgagaacttttgtgtgtgtgtgagacattctcactctgtcactcagcctggactgcagtggctgagcaatctccgcctcctgggttcaagtgattctcattcctcagcctcccaagtagctgggattacaggttcataccaccatgcccagctaattttttgtatttttggtagagatggggttttgccatgttaatcagcctggttttgaactcctggcctcaagtgatccgcctgcctcagcctccctaagtgctgggattataagcgtgagtcactgtgcccagcctgagaatttttttagagacaacatggtctttgtctgtctgtctgtctgtctgtctctctctctctctctctctctctctctctctctctctctctcacacacacacacacacacacacacacacacacacacacacacacactctctctctctctctctctctcactatgggtaaaagtaataattttcaactctggttaatttctgtctgaagccactttttatagaaacacagtggccactcaatgttctgggcagacatgactccctgctgtctccttgggtccgtgggcatttttaaagttgctctttttgttgaagttctgtatactgagacatcagctctagcaccacgtctttttagcccctagcatttttatttgtttttgtagcccactgcactgccatagcttaatctttctgtctataaatttactatctacctctacctctggctcctagtaattttactctttggaaggttttattttttatttaaaattttttaattatattgatttttttttttttctgagacaagtttttgctctgttgcccaagttggagtgcagtggtacagtgttggctcattgcaacctttgcctcccaggcttaagcaattctgcttcagcctcccgagtaactgggactacaggcacacaccactgtcccggactaatttttgtattttttttgtagagtctaggttttgctatgttgcccagctggtctcgaactcctgagctcaggtaatctgcctgcctcagcctcccaaagtgctgggattacaggcgtgagccaccatgcccggccttatattgaattattttgatgagtcatctcactgttgaataatgaggtatagcaaacatgaacaaaggaagaggagaaagcagcaaggaagagagaaaaagctcctttttcttcaggctagtttaaaaatatacattactgtgttgcagtttcttacttgattatggctggagggagttccactttaggtcatttcacctagttgctagaactggaaacccagagctctcaaccttcagtaggcattaaaattatttcattctgtccattcctgatacagtcattgagaggttggtatgtgtaaaatccatctcttatatttatggcataagtgtatccataaagaacatatttcatatatacatattaaatacacacacacacacacacacacacacagagttatttgattagatccttggtatcatgctgtatgtaatctgcagtttggttttattacttttttttttttttttttggagacgggctggagtgcagtgatacagtcataggtcactgtaagctccaagtcctgggctcatgggatcttcccacatcagcctctggagtaggcaggactacaggcacgtgccaccatgcctcctggcctcaagcaggcctcctacctcggcttcttaaaatgttgggattagattttatcactcttaattaaatatttgagaactttcagtgctgatacttataaaagttctaacttaatccatgcaacatgtcagaattctgttttccacatgtgccagcacttactccttgatctctagtaagctaaactatctcttaacatattcattagtccttcatatttcttttgggaattaagttttccttttttctgttttacaccatcaggggattgactattatttcagtatatgatgggcattaactaaccattcattttaatgatttataactattttatattcagattgtatttgttttctgacataccagtaagcattaggtattagaatgcattttaggatttgggactgcaatttatgtctttctgatgagtgtagaggaggttacatagttttatggaaatcaagtgctagattctggcctgtgagattttatattatttcataatgtatgttgtcctcctttactttggtcttgaaaacagaaagtagactgacagatttgtaaaatattttgtttacattagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagaggtaagttgagaaaatgcctttattcttaaatcttggtatcccttaataggttaatcaatatttatagaatgctatgtataaatttttaaagctttgaaaatttaatttttttagcgccttaagaattgggaaatcagagaacgaaagaaaacccgggaatatgagaaagaagctgaaagagaagaagaaagaagaagagaaatggtaagattctaggctaaaataagtgatttttcaggtaaaaagtcagattgtatctttactgctaactacaagtaacttaataattgaaatgcacaagcttctctattcatgtataatttaatttttatgtattttgagtaattttgagccaatttaagtacaccaaaatcttttttcctcttcaaatttttgctgcatctaaagttatctttttgtataccatcaaagtaaatttgtcatatagtaatatttaagtcaagaatttattaacttatttttaagaatctgcatatttttaaaattgttgaactgttgttattagatataatagttgcatttgaaattccgtaagttaagagattcattttatctcatggattgtttactattggtttagagttggggggcattacctttaaattgattgatgaacatgatttaaatttctgcgtttcttaaaaactatttcttatagtatcatctaccttaaaaatggaattaaaaaccatatacatatacacatatacatacatgtatacatatatatgtatatactttttttttttttttgtggagacggagtgttgctctgccacccaggctggggtgtgatctcggctcactgcaaccttctcctcccaggttcaagcgataagcgattctcctgcctcagcctcccgagtagctgggattacaggcgtgtgccacaacacccagctaatattttgtatttttagtagagacggagtttcaccatgttggccaggatggtctcaaactcctgtcctcaaatgatctgcctgccttggcctcccaaagtgctgggattacaggcgtgtgccaccacgcccagccatattttttcgtttaataagataatctccagttttgttggtgtgcttaggtattgtattttgaagattatattcaaagagcatatttattgtagcgtagcgtatatatatagtttgcattttacagatgcgtcctcattcagacttttcttagaggtaaaaaatttaaaatgtctaatgtgacctatacttaatatatggagtatatgaaaactaaaatttaagaggacaagaaaaatcttttttttaaccaaagtattattatatttattatggcatagagtggtattttatacatatctcattttacagtaaaaacattttatgtacaactgtagagagatagctgcacagatagctccaacttaaattagaaaatattttctctatagaaaataataaaaacaccgtttcccaggctagcccaacaagtttatttaaaccaaatagctgaatacatatacatttataaatatggtttgaattctgggatccaggagaaactttagtttcatttattgaaacggccatgtttgtcttaaaattatgtgaagagaaattcctataagtctccctcttactcttggtttatgtctgggtcagaaaaatctgtttacacaaaaaagggaagagtaatctttattacttgtatgttaattttatacattgtccttatttcctcaaaggccaaagaagctaaacgactaaaagaattcttagaagactatgatgatgatagagatgaccccaaatattacaggtaaagaaggcttgttctgtggattcatacttggttttttattagctgtgtttttccatctgcacagttgataatgcatgttcactaagtggaataagaaaaacaaactttcacattctgagtaattattaattctatagctaatacactgttttcgttgggagaaaagagctatcagaaaaggataaacatttctatgcatcttttgtgcagtgggggagcccatgatagtattatatcaaacaatactatttttttctttgtgtgttgtaaataggtctgatttttaaaattttttcttgattcttttagagacagggtcttacctcggctggaatgcaggggcatgatcatagttcactgtaaccttgaactcttgggctcaagcagtcctccctctgcagtctcttgagtaggttggactataggtgtgggctaccacacctgtgtgctaggtccaatttttatagcaagttacaacgaatctctgtaactatctgggtttttctagaaattttggtcttctagcaatttgacctcccgtctctcaccccatctccaaattgatacattattgtgaagtaacagttgtgacaactgccttctctcattctttgttcccatggcattttcaaactactctcattctagtatttgtgacattatgccaaaattgcttgttttgttcttccttccatccaaactgtaagttccctggggatgtagacagtgtcttgatactattttatctctaatttgtctgacatgatacaatcatagtgaagatatttaatatagttaaatttaatacagtatagccaaaataattaaaacattggaattagtagcttaaatctcaagggtgccagggatttggctttgtagaaagtgccatgaaatcagtaaaatattgaaggctagaagcataaagtggcaatgtataacgtcaacattctgagaagtaatgaactgctagataggagagaacctctgctttctgttgattctacactactttctgagataatttttacaagtgaataaattgaggatacagaactctcagtgctactaatgctacttgatatatttttttaggttggtatctaggaaaacgaaaattatttgttgggtattccttgtgaaataggcacaaagtgtgagctctctttctgaaagtgactattttacttgtttagacacttattagaatgactttaagaatgaagggaacatagtgataaatgacaagataatgcttgttatacatttacatgtagagagcacactctggtgtgttccgtagatacagaacattaagacattctttaacctcttagcatgcaggttgtaatgttgaaaagaggtgctgttggagatgtcatgtttacttctcaatgatcggagtattaaatgaagccttttatcattcacttttacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagagggtaagatactgtaccatctggtcgggcgcggtggctcacgcctgtaatcccagctctttgggaggccgaggcgggcggatcacgaggtcgggagatcgagatcatcctggctaacacggtgaaaccccgtctctattaaaaatacaaaagattagccgggtgtagtggtgggcgcctgtagtcccagctactcgggaggccgaggcaggagaatggcgtgaacccgggaggcggagcttgcagtgagccgagatcgcgccactgcactccagcctgggcgacagagcccctgactcctgggttcaagcgattctcctgcctcaggtacccgagtagtagtacggattacaggtgtgtgccacctcgcctggctaatttttgtatttttatttttatttatttatttttttgagatggggtctcgctgtgtcgcccaggctggagtgcagtggtgtcatcttggctcactgcagcctccacttcccaggctccagggattctcgtgcctcagcctcctgagtagctggggttacaggcacgtgccaccactcctgactaatttttgtatttttagtggcgacggggttttaccatgttggccaggctagtattaaactcctgacctcaagtgatccgcccatcttggcatcccaaagtcctgggattacaggagtgaaccaccgtgcccggccttttttttttttccctgagacagagtctggctttgttgcccaggctggagtgcagtagcggaatctctgttcactgcaccctctgcctcctgggcaagtggtcctcaggcctctacctcgtgagtatctgggacacttacaggcatgagcagaatgcctgactgaatactttatgcttttttgtagagatggggttttcctgtgttacccaggattgagccactgcccatgtccttttttttttctttttctttttctttttttttgagatggagtcttgctttgttgcccaggctgtagtgcgattctgcaaggctcactgcaacctccacctcccaggttcaagcgattctcctgcctcagcctcctgagtagctgggattacaggcgtgcaccaccacacctggctaatttttgtattttcagtaaagacagcgtttcaccatgttggccaagctggtctcaaactcctgacctcagatgatctgcccaccgcggcctcccaaagtgctgggattacaggcatgagccaccatacctggccttttctcttttcataaagatattttacaagaggtaatgtaaaacaaaaatcaagttgaatggtgtagagttgtagttaatcagattattgtttgggttttagatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtacgttagcatttccttccttctttattttcttcccttcacccctgcaaatacctgtattgtgctttaaagaaaaaaatttatatttgtgcttggttaggtagatagaagattactaaaaaatgcctttctagctcacgattgttttcatagttttactagtgctcctatatctgcagctgcctcgagttctgagaagaagtgaaaagtttaattttctagcacttgtgagtagtgagttattttttacagttgggatctttctctaagatttgtggaagtatattttgcattgcttttgagggatggtgggttataaaatgaaacatttggaaattaagtcatcttgctaagagagtgtttttactgtaggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctgtgagtaggaaattatatttcatcatattattgggaacagttggaatatgccatacaaattcatttgaagaaaaaaaaacctcatttgattctattaatgacaaataagtagggatgatcatcttgacaccaactcaatgccatggtcaagaaattagtaataatggaaattttttttgtgctacttgaagacttactaaaagcagatgattgtatcttgatacatatctgtcttagttcaacttgtgaaataacattatattttagtctcaggaaaaatcatgaagctttaataactgttatagcaagttacaattctttaattcagtaaccgtggtttgttttgcagatactgatggaacgtcgaattagaccatggattaataagaaaatcatagaatatataggtgaagaagaagctacattagttgattttgtttgttctaaggttagtcttctattctcttccatgccagcatttattttatatattaaaatattagacacttcttaaaagagcagaaattttacagagtcaagttccatgatggtttaggttcagttaagtgatttatatctgcttttttaaagttatttttatttttggtgtgtttttttttattcactgcagtggatgcagatttatgtctgctttaatgaacctttccatccaacttcagactcctcacaccacatgtttttatttcagtggtcgaggaggatggaattgctggttactgccaattgtgtgctgtctttctgcccctgagaatgctgtgccatcttcttcttgtcttggttggaataattatgttgagattttttggacgtagccaatatcttttcccaactcctttgtcagtcacccatcctttggataggatcaaaatagttcctttcatatcgtagtaacgatcagtgtttattgactgacaggctgtgttctcggcaggtattgtgttagttttgtttgttttgttttgttttgttttttgttttttgtttttgttttttcttttgagtcggagttttgctttgtcctacaggctggagtgcagtggcgcaatcatggctcactgcagctttgaacgcccagcctagactgatcttcctgccttagtatcctgagaagccggaactataggcatatgccaccacaccctgctaattttttttttctttttttgttttaaattatactttaaattctaggatacatatgcataacgtgcaggtttgttacataggagtacatgtgccatggtggtttgctacacccatcaacctgtcatctacattaggtatttctcctaatgctctccctcccctagctccccacccgccgacaggcccagctgtgtgatgttcccctccctgtgtccatgtgttctcattgttcagctaccacttatgagtgagaacatgtggtgtttggtttacaccaggctaattttttgtatttttagtggagatggggtttcaccatgttggccaggctggtcttgaactcctgacctcaagtgatctgcccaagttggcctcccaaagtgcggggattacaaggcgtgagccatcacaccagccgaagataaagttctataaaatgttaacaagacagtggcccacgccttgtaattcccgcactttgggaggccaatggggcagaacacttgtggtcacgagtttgagaccagcccggccaatatggtaaaaccccgcctctactaaaaagtcaaaaattgggtgcgctgggtggcaggcacctgtaatcccagctactcgggaggctgaggcaggagaatcacttgaacccgggaggcggaggttgaagtgagctgtgattgcgccattgcactccaagcctgtgtgacaagagtgagactctgtctcaaaataaaaaaaaagaaaaaagaaaaacttcttttaacctaacacttagaatctgtctgtcatgaatgttatacccattttatacatgaagaaattgaagtttaaggagagattgtgtcttggctatgttttatactgagtctagcctctgaaacccatgctcttaaccactaaggtatatcttcccattgtctcctgaaaacatagtcttaactttaataaaacagttaacatagtagaaacaccatatttctataaaggtatagctatggtatttttttgccagtagtgctcttttgatattatgaacagtaaatttactctgtcttctctaacttgtaattattgtggcattaaaacttgtgtgagatttgacttaaaattagactacagaccactatggagattaatattccaggttttggtgcctctttcgttgaagaatgatattctgaaaattaaaacatttatagaatggttccttagccgcaagaagttcctgtatgaatttgaggattcataccttaaaatttcttgactgtattgttaattttttatttatttttaatgtgacaattatttttctcttttaggttatggctcatagttcaccccagagcattttagatgatgttgccatggtaagttagaaattcactatttttatttcttttaatttaaaaaaagtttttggttttttttgtcttaaaatatagatggggtctcaccacgttgcccagggtagtcttaaattcctaggcttaagtgatcctcctgcctcagcctcccaaagtgttgagattacaggcatcagccaccacacctggccagaaatgcactattattaatattttaattaacatctatataaactcacttttgaatttgattcacttcctgcctgtctttgttccagaatcttttttaggcctgaattaaaacttgagtaatcccagtacttgggaggctgaggcgggtggatcacaaggtcaagagatcgagaccatcctggccagcatggtgaaaccccgtctctatgaaaaatacaaaaattagctgtgcgtggtggcgtgtgcctatagtcccagctactcggggagtctgaggcaggagaatcacttgaacctgtgaggtggaggttgcagtgagccgagatcatgccattgcactccagcctggtgacagagtgagaccccatctctaaataaataaataaggcttcattcttttccaccagttccattcatgttttccctatgcccagcacaatgtgctagaagcataaaagtagaacaaatgacctgtagtagcagagagataggtatacaggtactggaaccttgatgtacttgtttgaattagatatgtagaaaggataatggaggtagaggagatagaacatctgatggcattgatagcagttaggttaagcatcacaaggattactacaggaactgatacgtgtgtgtgtgtgtgtgtgtgtgtgtgtgtgtgtgttttaagtcggatacatgtgcaggtttgttacataggtaaacttgtgtcatgggggtttgttgaacagattatttcatcacccaggtgttaagcctagtactcattagttatttttcctgatcctctccctcctcccaccctctgccctacgataggccccattgtgtgttgttcccctctcttcgttcatgttttttcatcatttagctcccgcttataagtgaaaacatactgtatttggttttctgttcctgtgttagtttgctaaggatagtggcctccagctccatccatgtccctgtaaaggacactatttcgttttttatggccacaagattgtacatatgtgctgctttttggacaggtatccaaacacctgttgtattgacagtaaacatcaaatccccgttgcatttaatttgggattacagtcagtggtagcatgtagttaacactgtgattttgtgagacaaggaaaggagaagaaaattgatggtaaaggttgagcaagagattgaactatgatctccaagttaggaagagaagaaaatagtatctgaatagagctggtggtttgaatgaattaaggactagtggttccagtgaagttgtggaaggcgaattgtaataaaacaactgaaaggagaggttatggtcagagtgtagaaagttcaagtctatatgtgataggtcagcccagacgatggcaaggtgcatagtatgactatgggaaattcctgggtattgggagtcagattggagagaaatactggaaatagttgccagagcactcatttaagtggggggaaagactagatacttgccagatagctgctcttacagtggataaggtggtgagagctcatgaacgtccatggagttgtttttttttttaccaagaaagaaacagtgaagacccacaagtcattcctgtggagattaagacattgagagtgagagactgcctgagaagtgccggggctctaggagatagaggagggtttctgttaagaggaaaaacctaatttagttgttgatgtgtagtataaaatggaatagcggtccaaagggcagagcgggaagacagcaatgggaagatgagtaaggaaggaaaaatcatcaagcatgatatgaaatggtagatgactgggagtacttgcacttggaactgccaccagagatgtcagggagggacatcgtggggtttatagtcaaaaagaaggattgtgaggtctagctgctttgtgtccaggcattttatggtgtctaaagccagataacattccttttctgctgcctagctagcttgatgcagctgtcatttagaacacctgataaaacatttgtgaaaacttcattgcctcagaggaaaggagaaatgtgaatagatttcagtccttggggctgaattctgaactttcctgaagcttccagccccgtttttcttggagtagagggtgtcgtagttaggcctgagtgaagacattttttaaataaaactgtgttctagcgtttggcctcagcagagttcctatcatacatagtaaagatttcatgtcagtgttaattttagattttttgatctgttgtaatatattgatatttgaagtgtatttagaccactgtttatgattttgtggctcgttgattagaatgagaggaaaccagttgagctagtgttgtcaaacagctctgctaaaaagctcatggggccttgtaaatatttcttgaataaatgaggagactgaatttttagcctgagtactgtttcactcttaacaaaagtctgacttctttatattatacctttttcattttatgtaaattaaatgaagtttggttgcattttgtgcctacatctctctgaagtgtgactcagatgtgaattagtgttacaacagagttcttcaactaaagtcaaatctggctcatagaaatctgatcaaaagttctttaattaattattgctatcattgagaaagtgacagaaatttctttcttttaatttctttcttcttttcttttttttttttttttttttttttttttttttttgagacagagtcttgctctgtttcccaggctatatggagtgacagtggcgcgatcttggctcactgtaacctccacttcttgggttcaagcaattctcctgcttcagcctcccaagtagttgggattacaggtgcccacccgcacgcctggctaatttttgtatttttagtattgacgggtttcaccatgttggcccggctggtctcaaactcctgacctcaggtgatctgcctacctaggcctcccaaagtgctgggattacaggcgtgagccactgtgcccagtctcttcccaggtatttattaagcacttgttatataccagtcagttgtcagagcacttaactacataccaactcttttaattcccacttagtacctactgctatggtgtgtagctacatcgcctccactttagaggtgagggaactgaggctcaggttaagtaacccaaccaaggacctatcgctagtaagaggcagcagtgcaatttgaacctatgtagcctgactagagaatttgaaccaatgtagtctgactagagattgagtactctaaattcctaccccaaacttcctctatgaagacctggcaacactagaccacatttctggagcacagtcatagctgcccccttcagaagggagcagagtaggccatttcacctcatagcagccataatgtagaggggcagatgtgtgtatgggatgatggcaggaatagtgatggggacacaaggaccctataactcataagtagagaggaagacaatttcctcatccaccactggaagaagacttgttactcagtagtcatgtgtgccccgtgatgattgtatttgcttattgtgtttactgtattctggacactgtactaaatacttatattctcatttaatgttcactttagtgtcacatacacaataaatgctagttaagatggtacggttgggctgtgcacagcagctcaaacctgtaatcccagcactttggaaggccaaggtgcgcagattgcttgagcccaggagtttgagaccagcctgggcaacatagtgagaccctgtctctactaaaaagcacaaaaatgtagccaggagtagtggtgcacacctgtagtcctagctactggtgaggctgatgtgggagtatcacttgagcctgggaggtcaaggctgtagtgcaccatgatcatgccactgtactccaggctgggtgacaagagagatcctgtctccagaaaaaaaaaaaaaaagtttgtgaggttgtgtttttggagataaatgaaattctgtattgttattatgtaattgtatattatttagttcttcttaaattactgtgttctttatgaaaagcgtatggtttccttgggaagtagttttgtcagacatgtataattgcagtatctgtaaaggtaaaataaaagaataaaaggtggatcacaaaaatatggtactctttgtgtttagtaagccatggaattttgaatgatttttttttgttgtcgttgttaatttacatttactatttatttatttatttagagacggagttttgctcttgttgaccaggctggagtgcagtggcatgatcttggctcactgcaacctccgcctcccaggttcaagcgattctcctacctcagcctcccgagtagctgggattacaggtgccggccaccatgcccagctaatttttgtatttttagtagagatggggtttcgtcatgttggccaggctggtcttgaactcttgacctctggtgatccacctgcctcagcctcccaaagtgctgggattataggtgtgagccactgtgcccggtccatttactatttattaataatacatttctcacactggacaaattttctttaagtcattttactgaaagcaaaactacttcctaaggaaaacaaatacgtattataaagaacgtagtaatttaagaagaactaaatatacaactatgtaataacaatacagaatctcatgtatcccctcaaaacaaccttaaaacttttttgttttttttgtttttcttttttgagatggagtcttgctctgttgctcaggctggagtgcagtggcgcgatcttggcaagctccgcctcctgggttcacgtcattctcctgcctcagcctccccagcagctgggaatacaggcgcacgctgccatgcccagctagttttttgtatttttagtagagatggggtttcaccatgttagtcaggatggtcttgatctcctgaccttgtgatccgctcgcttcggcctcccaaaatgctgggattacaggcgtgagccaccacacccggccactaaaacaaccttaaaatcttaactagcatttaagtaataagtgcttattgtcagtggatgaaaaacttttttatactggccactgtttttggcagatgttgatgattgcttctcttacatgtgttgctgttttgtttcctctttaggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgtaa

SEQ ID NO: 2218 - DNA, 27316 bp, Homo sapiens
aggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccggtgagcaaacttggtgggacccagagaccagcctgggactctagtgggtgcagacgctacgctcgcggcgggagcggggggcaggaagcaggaagcggccgggaccgcgtgggtcggagaagtgggggatggtgggactcctggaaagtcggaaccccctttgggaaccatccattcataaattagggtggggccttgcagttcatctgtgggtccattctctttacagatgaggaaacagaccttgagtgagcgacttgttcagagcctcacatctacagtagttagacgcggagacagaatcagaatcttaggcttgaggcttccaaacttgcgtttatggcttactgtaagcgggaaacacattgcagagccttatttaatcaatctcctaagatcctgcgggggtaaagagctccattttaaggaaaggaaaaccgagtgcccgagatctgacccagcttgtccaagtttgggtggttaagtatacattttgcccggcactgatctgggcggtgcatgtgggaagatgaatagggcccagttccccgactttgagggcctcacaggctgatgtgtaagagacaggaaaacagccctagtgctttgtgatcaaccttgtggtattacagaagaggaagtttaggaaggcactttagaatttagtttggaagaatgatttcaccaggtaaacaggcaggacggggcttcccacgtaaaggtagggaaggcagtgaaaaggggcacgcaggtgaattgtctttcgggttgtttgcaagagatatgccagaagggttaaaggaacagtaatcagaaggatcttaggcaacaaggatgtttgaaacttgtattctatacatgaaggatcttaagcaggaagattgtatttgtaaaagtcacgctggcattgggatagaaggttaggccacatgcagaaggctgttgtaatagtccaagtgagaagtggtgacgtcttcagctaagggatcctctatcccaagtctgtgacaggacagttcacttaaaagccaaatttttttcttgattgtccactcgagattgaatggagaaactgcatacgggcacattctaactatgtaaatttaattctagatgataaatggtgactatacgtagatttttttcacataaaatgatatttttactgttttgtaacttttttttttttttttttttttgcttaatagaatgtggtcaacaactttccatgtccataaatattctcctgtgctattcttaattggacgtgatatgtatggttaacacatatgtaatttttccttcctgtaataattatacaatagttaatatttattttgagtactaaatacgagtttggcactgtattaatgcattccatgaattaactcattcagtcttcttttttttgagacggagtctcgctctgtcactcaggctggagtgccgtggtgcgatctcggctcactgcaagctccacctcccgggttcatgccattctcctgcctcagccaccaggcctggctaattttttgtatttttagtagagacggggtttcaccgtgttagccaggatggtctcgatctcctgacctcgtgatccgcccgtctcggcctcccaaagttcttggattacaggcgtgatccaccgcgcccggcctcattcagtcttcttaataacgctgtgaagtgggttctgttattatctccattatacagatgagaaagcaggcgtaggaacagtaacttgctcaaacccagtatccccgtttttttccttcctcaaacccagtatcctatagccaatactaataacccctgtgctgttctgagtgagtcagggacagatcattcctgagaaaggtaattctgtagcttctcttcacaatccggttctgtttcccaacttttgggttgagattttagattacttgtatgtagatgtacataccatatatactcagggaaatagagaacagttgcctactctcttcccagtgttgtagaaaaggggtcataggcctcagggttccagagagacctgttgtaatttcccagctctattacttaatgatacaaatgggcaagttacttctttgagccagtgttcttgtttgtaaaatggagccgtatttagaaccagaaaacctttgtggtgattccctctctctctctccctctctctctctctctctctctctctctctctctctctctcactacccctgttcatttggcaaatggtcaaaaccaaaataatcttatcagaaatataaaacttattttatcatctttccattttaaacctgcacagacctgcaatttttctttctttttttttttttttttgttgtcgttgttgttgttgaaatggagtcttgctctgtctcccaggctggagtgcagtggcgcgatctctgctcactgcaagctccgcctcccgggttccagccattctcctgcctcagcctcccgagtagctgggactacaggcacccgccaccacgcccggctaattttttttgtattttttagtagagacggggtttcaccgtgttagccaggatggtctcgatctcctgacctcgtgatctgcccgcctcggcctcccaaagtgctgggattacaggcatgagccaccgcgcccagccgcaatttttctttttacccagtatacttgatcagttacatcacttctgcagtataacaaaggctctattgaatctaaatgaacctttaaagtttattaaatccagacttctggagtaggggggattttagctcagcatgaaattaggagtcatattttaaaattagttttttttttaattatacaagtaacgcattttataggatttaaaagacaatggccaaaatgtccatcaactgataaatggataagtaagcaatggaatattatttgataataaaaaggtacaatgacaagtattgatgcatgttacaacctgatgatcttgaaattattatgctaactaaaagaagcctgtcacaaaagaccacataatgtgtgattctatttatatgaaattcccagaataggcaaatctatagaaacagaaactaggttaatggttgccagggtctggagatgaaggcaacagggagtaaactgctaatgggtacaaggtttctttttgagggtgatgaaaatactctaaaattgatggtagtgatagttgcaaaacagtgaatacctaaaaaccattgaattgtgtactttacatgggtaacttgtatggtatatgaattgtatcttaaaacttaagaaaactaaaggtcacaaacatgcaaactaattaaaatccctgtttacattcctggcacaggatttattactttaaaactttctatgacttcacttgcttctaattgaagtctgtattccttatggtaacttttagttcttgcttctgtgagccttagtctgtcttaccttgtattactttctaaaacaatccttcattaatcagcctggtttagtcattttttctctctttaaattttaacatttctgacaacaagcttatgtgtacacataggacacatttcctgtattctcagaatccacctgttgaaatgcattccatcctttaaaacgctagtcctagcttatttgacatctaatcgtagcgttactactgtgttttctcctccgggagtttctcacacatgtatgccttactttccctggagagactaggtttacacatggtagggattgggccttatgtttgcttcttccatggcttttgttagcactggtggaattcatgggcacactttgcattcagtttttttttttttcccctggaaatatgcttactgaatcaactgcgtgcttccttgtggccatatgtttggtatgtggtccaagtaaacctgaagcgagagtcacaagaatagttaaaataaaataaatgaaatttgaggagttaaacatcgttagtaactccttcctactttttaaagacttgcctttattgtaagttgttaacctgtctttgccagtgatgaaattgttcagtctttcaatatcagatttccattttttttaaattaaataacaaatactaaaataacattctcaacacttcctggggcatcacaggatggaggtgtcacattagattaaaatataaaacgttttttgcttatttagattggtgctggtgaagagaagcaaaaggaaggaggcaaaaagaagaacaaagaaggatctggagatggaggtcgagctgaggtaaaagttatcatcacagagggctctgttatcagaggttggcaaatcgcagggaactttctgagactttcctaatgtgtaagggttctaatggtttacatggtagtgtaagatggtactggttggaaaaatcaggaagaagaattaggaaagggtaatctgagaggggaaaaaagactttcagttgttactgtaaaaggaagcaactggcgtatgattgtataagatgatctgattgtagggttgaatataaaaatcagagaacaaaagttgaagaggagactggtaattattcagttgccagatgtgatgccagctctgacatttcattaaatgagatgttagggaatagagacttggtgtttgggcttacactgaatacaatgaaaaccaaagaaagccagttttttgaccccctccttgccctttccatctggacctgccctagggttggcttctaagccaggacagatccccttaaggcctctcaagtctgcagaaaatgctttcacttctccaggctcacactgaaaggaactggcatatcaaaagccagccctaaatcaacctggttcctgagtattttgcttttacaggcagttaagcttgcctttctactttatttttactgctgtgaactgtgcttcactttttgctttagtcattacagctgttttattggagactctttagaaagctaccagaaggaagaagcacaaaggaacagcctttttagaagtagcacagtaagctggcttttaagagccacttttacaaatgctgcaattgctaaatttatagtgccgtcatttactttagggtaagtttatagatgatcaagtgtagtgttgcttagaaccctacctaaccatttatcttacggctgatcagttgatcagtctcccgaccattatacccccactgtaattgtgaagaaaattgttgattgtgaattttaaaatttgcaagccaatggaaaaatgcatatgttccctaatttcttttttatactttcaatacaaacatacgtgctgttccatcacagcttgagaaatgacctggaaataagacaaagagtataattagaagactcttctgaacagagaattttaagtgggacatgtgattatttatgtttaacgattggtctggaaaaaagagtgtacagtgaactgtccaagaccttggtcttcccctccaagggcaacttgcaggttttattcatctctgcaatcacagagactgacacagagggtatctgctgaatgaatgttgaagagattttgacacgaaattctaattgggacattgcaagtggctatgatgataaactgcagttaagatacagagggtggtgcaggtgggtaggattataatgatgctttagagtggatggaactgggtactgtgcattagtctgaggggttcagattatggttgtagaatgacaggctctgtctgagcttttagttaattcatgggttcttcaccattgaaggttatggaccgttgtgataatttgatgaaaagctctcaacaactgaacgactaaagaaagggagggactgctgtgggtgggaattacaaagatattagggcctgatacggtggtaggaaccaatcacttgagactgagtgggagaatcactggagcccaggagtttggggccaaaatgcgctgtgactgtgcctgtgaatagtcactgcgctccagccagcctaggcaacatagtgaaaccctgtcgttaaagaatggaaagaaggagggagggaaggaattactgggcagacaattaatctttttcatttgatattattttctattatctccagtcaattttgttttgttttgttttgtttgagacaaggtctcactctgttgcccaggttggagtgcagtggcccaatcttggctcactgcaacctccacctcccaggttcaagcaattcttatgcctcagccccacaagtagctgggactacaggtgtgcgccaccacacctggctaatttttgtatttttagtagagataggattttgccatgttggccagggtggtatcgaactcctggcctcaagtgatccatctgccttggcctccctaagtgctgggattacaggaatgaaccaccatgccctgccccagtcagtttcttaaggattagatattcccttgtactcctttcaaattgtggtatgttgatatatatggagacatatgtatggagacgttggtagcattatcaacattgaataaatgttaaaatctgtattgcagtaagtcattttatatctgatagattgaaattcatttgaagatagaaagtcatggcaaaattaagcaatctcctcttcacttttgtatgaagtgttaatgttcatgtaatttgaagatgatgaatgctgtagatgttagtttgactgttttgttaccacagattcactgcctttttgaaatgttccatagattatagagtgacagtagaagaagtcagctctctgattgctgtctctttttctttctttgccaaacctctagaaacctaagtgggtgttttatatagaatatttttgttaattttatctgctatagaaagtagtagtgtgttgttttatatagttgctaattacatactccaagctgatcatggcatctttgaattcagtaaatactttccttgaaggggagaccttaagtcaaagaaatttgtgattggttgtgagtggacatataggctgacccgctgcacagaccatcacctggacatgaatgaaacaaaatagaaaagccagtttattgtttttatttccagtattgtttatagctctatttgtaaaataatttagttagaaaagatcctaagaagacatcttaaaagagaaaagaccacttgctgtaaatagtagcaaaatggtaattgtcgattcagcataagaatagggcatttaattccttcttttaccttcatttagaaccaaattgaggtaatgccgggtgattttggcagtgtttatttaccacattgaatcaatagtcctgggtttctgtattgtttttattatttctttcccatttctaaataggaaagcaatatttactgatcatttatttcctgatttgtttgttgtcttgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattaggtataagctacacccatcatgaccttccatagtttgtggtctaactaaacttccttttattatcttgccatgttttattcttataatatttttatgttaccattcagtgtttttaatctgtttaatttgcctacttgagattttttaaaaatcaaaatgatacagagctttgtagtcaaaattcaaagttaatttctgaaagagtttactttggtcttatcttttggggcattgtatatttttagtcttactatgattataaatgttacaaaaccgactagacagtgtttacctatttcgacttaaatgtcttggttttgaagttaaaaatgaagctacataatctcacatggaaaggttaagaaacttcatataacacatgaaaaaaatgtactatttttataaattcaatgaaagactattcctagtcttaaaacttttattggggtgggaagaagttatttcaattaactgagaattagatgcatattttgtaataggggagaggctttcttaatctgatatgattgggatcaataattggtcagtttatcaaaataagagttggtaaaacatatatatgtgtatatatatacgcgtatatatacacgtgtatatatatatatcttaaactgggtattgggaaactctagtcataatctgtttgtgtatgtcctgaaagcgaaaaataaaaatgattctttttttctttctttttttttttttttttttttttttgagacagagtcttgctctgttgcccaggaggctagagtgcagtggcgcgatcttggctcactgcaagctccacctcccaggttcacgccattctcctgcctcagcctcccgagtagctgggactacaggtgcccgccaccacgcccggctaattttttgtatttttagtagagacggggtttcaccgtgctagccaggatggtctcgatctcctgaccttgtgatccgtccgcctcggcctcccaaagtgctgggattacaggcgtgacccaccgcgcccagccaaaaatgattcttaaatttttaaatagttggaaaaaataaaacaactaagaatatacaacagagaccatgtttggcctgcaaagtgtaaaatatttgtgtggccttttacagaaaaagcttgccaatcttggtcttaaacacttcaacttaaaatatgtgaatatgtatgtattcactaactttatatacatacataaaacagtgaatatatatatgtatggcaaggtttgggggatagcgagtgctaattagagttcttacattatcttaacacatacgagaagtagtctgagcacagaatccttgcagattttcatgtagttgtagagttacacctaacttgacagtgtttttgtgtgtgtgacttggatttatcaagccttctcaaacattcaacttggttttcatagaatccataattcccttattgtgttattttataattatatatttttgaagtttatttataagtgttatgtattgaattgaaccatttggaatcaccatatgaattgtcatgtggttgattatcatcaattttgtattgttgaaccaaacacgtaaaagaacaagcacaaaaacagtttggggaaccaacgtggctgattcttggtaagcgtattatacaactagtagaagcagaaccagttaggcctatgagccatgagcatctactgtaccacagacattagttagtactttttacaaagtgaatggagtgtttccattcatttgacaagtgcttctacctacaagttcttctaccttactccaaaggaagtaaaaagttgtaataccatgcaagtttctatgtgagagcatagagaactggatagacctttacgtatcagttcaacctttcattttagagataattttgaaggtcaggttgattaatagattcctctgttgtcacacaatgagattgtagccgtgtcattaaaatttaggcttctgttagtttgggaactttttcctctaccttctacaatgttgatctagattacattgtaatttatcaagtcttcagttgaaaaatattcttcaagaactataaaattctaagttgaattacatagctgggcgtgttggctcacagctgtaatcccagcactttgagaggccaaggcaggcagatcacctgaggtcaggagttcaagaccagcctggccaacatggcgaaaccctgtctctactaaaaatacaaaaattagccagtcatggtggcgcacacctgtagtcccaactacttggaggctgaggtgggaggatagcttgaactcgggaggtggaggttgcagtgagccaagattgagccactgcactccagccttggtgacagagcgagagtccgtctccagggaaaaaaataaaaggttgaattacataaaacattgatgggctttagctctggagttaagtcactgatctgcactgagaatactttatgaaatttttacaaaagtccagaataactttttgttctgtgaaaaattataacattgataacaggctatttaaagattcacataattagtggtgaatatgaaagggaaggacaaaaaagacatgttccatttgcgtcaaaaggtttttctttgaagttttgttataaatcttttttttttttttttgagacggaggagtctcgctctgtcgcccaggctggagtgcattggcgccatcttggctcactgcaagctccgcttcctgggttgacgccattctcctgcctcggcctcctgagtagctgggattacaggcgcccgccaccacgcctgcctaatttttgtatttttagtagagacggggtttcactgtgttagccaggatggtcttgatctcctgacctcgtgatccacccgcctcggcctcccaaagtgctgggattacaggcgtgagccactgcgcctggccgttttgttacaaatcttaaagattattttacccttctttgaaaaattgaaatgatccagtatggcccatgtgtaatctacattttcagagtaactctattcttagaatcttggggctccatattggatcataagataaaagtcatgttcttcccaaagaatatagagaatatgattatcctttttatcagttctttaatctcctgaaaactgttttacaccaatatgatgaaatacatttctctctgccaaattcatgttatgttttgtgaaatgcatgtatttattttattgactccatctgatctcaggaggaaagaaaacattgtttataacctatggtaaagttagtaggagcattgaaaatagaaaggagtttgttgtttactttctgtttggttcttttctcttgatcctcagataggagttgtatacattttgttgtaaacccttagacatagagagccaccaacacagcaagcctggctagcttaaagccttctagtggtaggtttctttgagatttacagtgtaaagggtgtatactttttcttcacagtgtagaatgttgcctaccttcgttgagatgtccaggctgttatagactattatttctctagctgtgcatttagatgtataatctggctcacctactcaactctgctctagtcacacagcttcctgcaaaaacctctcttcacttgcatctctgcttgcatctgtggccattccctcatctggaatgccatggcctcctcttttcttcctgtgagtgctttatcctcaaagcctttccagatgactctgacctgtactgctttccctcctcagaactcctgtagcttttacactctgtgtgctctgatatttcatcacttgatgatactttatgttcgatgttgtatattgggtgtgtaatgtttttactcacattatatggaaagttttattaaatagtctttcattttacctctatatttgttataaatattatcataggcatttgcagaatttattctgaggttagcattgtctgtcaaagaaaggatctggtgtacattttaagcaggaagaggaacagagaagttatttagtaggccttttttttttcctttggagtctacatagcttagctttgtagaaagagaaaggtgggtgtattaagagaaaactcggtgtggtgacttgtgccagttgtcccagctactctagaggctgatgttggaggattgcttcaggccaggaggccagcctgcgcaacatagcaagaccctgtcgctaaaaaattaaaaaaaaaaaaacttatttgttggagaaattaagattattcaaaccattggaaattgatagtgcttatttatcagagttgccatatctgcttaaacaggaggcattcaatgtcaaatgataatgttctgcattttcaggatcttccagttaggttcttaggtacatttttggaatttgttgtttttatcattatatttcagaaaaatagagatacatcaatataaaaaaacaatatataataaaaatagtgtttattttcctgttttcaaattagattcgtgtgtacttatatatgtgtggacttttttttttttttttttttttaagtcaaggcctggccgacaacaccgttattgctaaagtaaataatgttgtgtgggacctggaccgccctctggaagaagattgtaccttggagcttctcaagtttgaggatgaggaagctcaggcagtaagttgctgattagtattcattgaattttaggatgcagattcacatttgaagtcttttccagctcagtcctgctgcgattgggtggctaacatttattgttgtctcactgtcatatttgaaatcttcattttgtccttcatttagggaacataataaaagtgcttgccttagaaaataaaggggtgaagctgaataagtcttttcattactagacacttcaatagggaaaatgttttgggaattgtattaaacattgattaagcaagtaaaaattgttttctaaactgtgaacactattttattttaattttttttttttttaatgatggagtcttgctttgtcactcagactgtagtgcagtggtgcgctcttgcctcagtacaacctccacctcccaggttcaagctattctcctgcctcagcctcccaagtagctgggattataggagcgcactaccacacttggctaatttttgtatttttagtagagatggggtttcaccatgttggccaggctggtcttgaactcctgacctcaagtgatctgcccacctcggccccccaaagtgctgggattataggtgtgagccactgtgcctggcctctaagctatgaacactctagcaagatatgtacatttgacaaataaatttgaaccttacttcaaagcactgcctttattggataatttctgtatttttttctcatcttaagatgcaaatctgctggataacactataaaagtcaacctgcatgtgatgacaagattttctttttaattctccatggctgtgtatcatataaggggagacaaagtattttgttttagtgatgattgttcacttatgtatgtggattagtggttttcaaatgtattttggagccctcaagtttcttacgagaattttttaatgtcactttggtaccttaatactaaatcttgaaaacattgctttgggtgtattctgactcatcccagtgattactttaaaaccaagtactgccatttgatttcagtgtacagatgtttgtcctcgtgttttgtcattgtgttgtggggtcgggttgtaccacctttgttttgggccagtaacaacatgtaatttctaagtgatgttccatagccagctaaaggccagatcacagtgtctgagacatggtgctgtgggcacattgactcaaaagaacctgggccattgcaatcaatgagttagtcacattgtgagtagcagttgttttcagagaacaaagtctatgtcatttaattagtgatgccaagtttagtttaatttgtttgaaaacagctaaaccagatgatttccaaaataaaaatacactagtaattggaagccttttgaattactttggctatggatagaaacagtagtttatagatttagaaatttaggattttatatattgggtttacttgtagtaaatattatcatctgtctctttcagacaaccacattaattggcaacttgtatgccaagactcagaccatgccatttttctttaaattttcaggtgtattggcactctagtgctcacataatgggtgaagccatggaaagagtctatggtggatgtttatgctacggtccgccaatagaaaatggattctattatgacatgtacctcgaagaagggtaagccatcaactagataaagaaaactgaagtcaatgactatggatccataagttattcttaagagttctcagtaagggaggaatgatatagatctcactgcttcttcatcaggtatgcccattatcagtacttgaagtgttgcaatttacctgaagtaatagaggatttgatgagacctctgttctagattgatggaggtagagtcctaaggtattttgggaaattcagggagactggtcctcccctctcctttaaaacctggtgatagagttgcgggaaggggtcactagtgagaaaggtctccatggatgaccaaggtagaagctactgaaaatataaaatgtaaaaattacttatgaaaaatgttttgtttagaattctaagatacgatgcaatagtctaattttttaatattaaaacccttgaagtattccaaatactatttccaaatgaacatttttcgaagccatggtgtgattcgaatggaatgaaaagattatactttcttctccttcaggggtgtgtctagcaatgatttctcttctctggaggctttgtgtaagaaaatcattaaagaaaaacaagcttttgaaagactggaagttaagaaagaaactttactggcaatgtttaaggtaaattgaaccatagtgcgtggcccccactgttaatatcatttattcatgttagttgaagtgacaccactggcgttccgtgtactaagctgaagtctaattggttctttagcaaaaattaagtgtttttattatttttttaatttcatttttttcctagcaaaccattccttcaacatgtttttaaaacatgaagtatcaacatttatattcatacagtgctacgttttagctatagtacttagaagtaaaaattaaaggacagttttttaaaataataatttttcctgttttcagtacaacaagttcaaatgccggatattgaatgaaaaggtgaatactccaactaccacagtctataggtaagaatattagatgtcattaaatgtatctggtatgtatgtcattttgtctttgttaaaattcctttcattttatctttagatgtggccctttgatagatctctgccggggtcctcatgttagacacacgggcaaaattaaggctttaaaaatacacaaagtaagtaatgtaactttaaagactgtgaatgtatctgtctagaatagatatatgtttaaactttcactgatttctctttaccattttctgttgcacatgaaaggatggtattttctcatgctctctattaactgggagctgtatgccatcaggattttataattgaaatccctcaaggggtgactgacttgctgtcattgccagagcaatcacaggggatggagattttacaaaatcatacagcatgggccatcctggctctataaaagctttgagactcactgggagtatgtgcttttgccctttatatgtctaaattaataatttcccaagttgttgtttttaacagaacccagttttatactagttcataaacattttatggaggtttttaaaatgcactttaaatcaagagaataattgagtcatttcaagattttttttttattggctcatttctatttttgctcattttgtgagaaatgcctttgcaggcaaagtaatgtttgtggaattgtggttgagtattgaggggtgggcagttttgggggtattggggtgtagaatgggtctcactctgttgccccaaaaagacagagtggaggaccacttgagcctgggaaatgaggttgcagtgaatggagatcgtgccactgcactccaggctcaagcagtcctcctgccttagcctcctgagtagctgcgaccataagcgcacaccaccatgcctgggtaattttcttttttttaaataaagaatggggtctccctgtgtttcccaggctggtctcgaactcccaggctcaagcaatcctcttgcctcggcttcacagagtgctgggattacaggcatgagccactgcacccacctgcagattgagggaggggcatttttgaggatagaaaacagccaactttgtgctgcagaatgagtaactactctaacaaggcctcaaagcaattgggagttaaaataagtgagatgtttacaaatttgaatgttgtttcatggttaatccttgttttcagaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggtatgttcaagaacaatgatgtgtcttgactgagttttcttcaacttcatttgaagtttgaaattcagctgcatgaagtactaggaattttgttttgaagagatgttgtggctttttagtaactggtgctatgtcctgtacaaactataaacacttactgattgtccacattatctgcctggagtatgctcagtaccgcacaaaaatgcatttgaactacttttattgagagcaaacactgatgatctacggttttctgtaaaagaagtataacagcttctcatagagctgggagaactatggaaaccctctagtttcactgactcatttaaaatgtggaaacagagtcccacaaagattaacctacttgttgcccaaggtttagcagcatgtcgcacatggatcctgtgctatcatttcctctacccattatctctgttactgctgaatgtcctctaaactggaagttaggctagataaaacattcccccttaaaataggcactctgtgccaggggtccttggctattaggttatgaagcttgagctggaggtagcagccactgccttgcacccctgactacctgacattccagctatgaggcagccagcaatgattgatgggcccttccctgagggcttttgggcacttggggaggcggatgttggcaaggaggtaggagggtgtgtttctttcaccatgacccaaagtcagccaactttaccatcatctatttcattatcagtgtctttttcccagtctccttcctgatactcttactaagaaaataaatacatacataaataaaatgaaaaaagatccagatcttggagctttaaggaatttaagaaccatgagaggtactgcagtggatagttaaagaactgaagggacccttattccctgccactgttggggaaacttgactggattgaggaatataacaggcagggcatgtgttacacgtctgccaaattgtaaatcagctgcaattctataacatcagaaacactgacatggtttctttgattcaggagtggcactgattgaaatatgggacatcatgaccatattctgagctcaagaacactgaaatttatgtatatatacacacacgtatacgtgacgtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggtctactaaaaggaaagataatctgtatttgagaagaaatatataagacgataagtaaaagtagaagtctgtggcctcataaatcatccctaatagttgattttgcccatatacacatagaaactggtgagcttgaagggggacctgtggtccttgacataggagctctgtgccctctttgactttgatcatttatttgtattttctttgaaaaaacggtttttacattgcttttttcctttgtaaattatgaaatgtttcaagtataagtttatagagaatagtatatccaatatcttgtacttaactacccacatttaacaaatattcacattgggctatatttgcttgagattttttcattcatgatattaaaaaaaaaattagttgtttaaaaagcctctctttaggacccagttttgatccatatacctccatatactggtatatatatccatatactggtatatcatataccagttttctagaagaaactactgttttgaagttggcatggattctttttgtccatgttacttatatctagcccatgtatttgtacccttaaattatttatgtatttgtgtgttacatataggaagcctcattgtgtatcagactgccttgtgatttatttttagagacatgcaaatcaagtttattttcacttgctacatattattttgttatataactaccacaatgcactcatccctgtattgatggacactgatgtataattgtcccttattatcagccatgctgcagtagcatcacttttataagcctccttaggtacatgtgccaagagttttctctctggtatatacttagaagtgggatttctgaatcatggcatgtgtccatctttttcatgagagagtataaaatcactctttaagtttttactcccacttgaagtatgagcatttatttgcctacacatgtttctgtttattttctatcagagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactggtattcggcagctttgaatttctactgaagattttcacatgctacaattcatcctgggttcttccctcctttaacaacattttcattaaaaacaaattatgtgatcagaagagcatttaaacgcaacatctttgtattatatcttctgcacctgattagatccccactttttttttttttttttttaaagaggtcttccaactggagtgcaggtatgcgattatagctcactgcagctgggactgcaggtatatgccaccatgcccagctaatttttaaaattttatttctgtagagatgaggtcttgccacgttgctcagcctggtctcaaactcctggcctcaagcggtccttcaaccttggcttcccaaagcgctgggattacaggcatgagccactgtgcccagccagatctccagatctgtgggcattcagtaatggtactgggatcatagcaatgaccaaggcagactataaaacaggaagatgaaatatgggggtgtaacaaattacctagtgtgttgttgttttaaagaaacctgttctgtcaaaacctgctaatgactcagcattcttggaaaatgttccttgtcatgaggccgctctgctttctatctttgaaagttgggtgaagaacagcttaagggaagacacaggagagctgtggatacaggtagcttagtgtctgcagctcctactagccaggcctggagggcagaggaggtgagagaagaatctttgtgaagaagctgtattataggctaggggaccaaccaagttcattcttaattttcccagattcttcagttgttggaatacgttttttaattcttcactgtggttcattgagttataacttatttgctgttttattcatgcaagtgcttttactgctgtatgtagcccagaatttgagaaatgttgcttggatggacagctagaatcagtggctttttgacaacctttcgtgtaattaaatatagcattacagaagcagttttattcttaagtgtccgtggacttttctttttctcttcagccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcaggtatgagaccctgggaataaaatacttagaaagaagagtcaagaaagtcaaggaaaataactactgtttctttttttgttttttaatttgaagattgaagatgaaataaaaggttgtttggattttctacgtacggtatatagcgtatttggattttcttttaaactaaacctttctactcgcccggaaaaattccttggagatatcgaagtatgggatcaagctgagaaagtaagtggtgtttttcagcgtgcttttgaatactgtttgaaattggcttgttctgagatgtaagaaagccaagcctctttaaatggataaaagcaaaatgaaattggaaatggttcctaggtttgtgtaagctagtttttttctttatgattgtgtatttttgaaatggttgaatgttttcatgacttttttcagttatcaagctataagctttaaaaaggggttggtatgagcatatgttcaggtggacaaaattctaaagcagagaatattgatctatgaaagtaattactgtatttttagtctcaaattaggctaaaagaagggaaattgcgatgaaaaaaataaaaatcattttgctttatcctcagcaacttgaaaacagtctgaatgaatttggtgaaaagtgggagttaaactctggagatggagctttctatggcccaaaggtgagcactaaagtacatttgggtaatatgattttcacttgtggatgaagaagatacgacttcgaaaaaagttggaaaaaagaaaatcagccctaatccaactattgagctccactttagtatcactggcattttataataacccagtctttgcttcttagattgacatacagattaaagatgcgattgggcggtaccaccagtgtgcaaccatccagctggatttccagttgcccatcagatttaatcttacttatgtaaggtgagtttctggtgtctgctctgaatattctccagggatatataagagaaaatatatataataagacaaaacaattttttttttctttatagccatgatggtgatgataagaaaaggccagtgattgttcatcgagccatcttgggatcagtggaaagaatgattgctatcctcacagaaaactatgggggcaaatggtaatttttgtcactgtcttttttttctgattagtataaattggctacaagaaatgtctacttttcgatttaattatcagatggaaagggagaatgattccaatcggttgcttctaactaacgacaagtgttcattaaaaaataaggaatcacaatctaaacacaaactttttagcattaagaacaattgctaatagtaattactttaattccagaacttgatttgtttggatgttgtgtaatactttctaattaggaattagtattctgtaagaagtatacttactgttttggatgcttttctagtaactttgttttgggatttagatggctttgctggttttacatagataaatgaggaggcttatggctttcttcgttcagccttgctaatcataacaagcaggtatttggacatgttttaaaagccaagcattttttaaaacagatgccaaaccgatcaacatttgtgattcatttctgtgaggttaagtaagtttttgtttccaagatacatggccacataactttcatcttaattcttaagcagttttttctggacccacagtgcatttgaaagcagcacagggttataaaagcacccgtgtgtagagccttccatattaatcatattgatttaaaacttttgtaaaatgacgtacattggtttaatcttacacattactgtcatttcagttttatttgaacttggttacttcagaaattaggacagtttctcattctgatcaatgatacaagataatctctagatttctcaaagtcagataaaatgtgagacacattctctgcaaggtatttcaagaattaagggagtcctcagctaattgctctgctaaacctgttttaggtggggaaaagtccatgattagggtagaatttagtgcctactttagccttttgcctgatacaacagaacaactgaaaatagaggaatgatggagaaaaacattagcctgatgtttgcagcatcagaagcatttgacacttgtattgcttcaaagggagaattggatgggcttattttttaataagtagtgaaaactctgatttttaccaagtgccataaccagttattatcaattacaatttgctgaatgatacaaaatggatgttgagtaaactgagggcactgtgtccccgtgaagaataagtaataaaatgaacaattaatcactacatgcagttattaaatcatttgttacctcctctcacagccaatacacagtgttttgtgatgtattaaagtgtgaggcctagtcctatcctcaatttgctttgctatctacttagcaagacaaattgtagttacaggctttccttacgtagggttagttttcttctcctgcatctcctcgccttaatctttattggataggtcttttcattttggggttttttaaagccaagttttaaaagtagtcgttacatgttccaggaaaagatactgaagagtagagtaagaaatatgctgtccctgtttagtgaatatgcccacatctacactgaatatttttattctcttccaaaggcccttttggctgtcccctcgccaggtaatggtagttccagtgggaccaacctgtgatgaatatgcccaaaaggtaagccttagatatgaattttctttcaatttaacatctgttgttcagcttttcaaatcacataagccctgtattcttggtgaatcgagctgttgtgataaagagaaatgttactatttttaatctttgttaagcctgaatagattatattacttctttaatgcttttctccatgattccataatcagaagacatatttggatagtgttttatgtacacttgtatattttattgtatttgttttaagagatgggatctttctcttgccccaactggagtgcagtagtacagtcatggctcactgtaacctcaaactcctgggctcacgcagtcctcccaccttggcctcccgagtagcagtgactacaggcaggagccaccatacccagttacacttgtatattttagtatttagtattttaaaaaaccagattagcagatatcaggtacttcagtatggtaggtaaattcccgttcaaaatacagtttaggctgctctttgactcagtgagtaattttgcttcattttaatgtaaatttcttcaggtagttgaaattttttcaggttaatagtatagcagaccaatgtcttgcctctctaccaaaaaaactaacttaccaacaaatgtatagccattcataacttcactttaaagcattgttctgccatagtgaaaattccatactaaggaatttcaaattattaaaagttgatgagtgaacaatactgtaacatcaaaaccatcatgtcttcagaccatcagaataaaccacactcagttcttaattacccttaagaaataaatgaacttgagcatggagatgcatacctgtagtcccagctacttaggagcttgaggcaggaggatctttgagggttcagggtgtgatgattgtgcttgtgagtagccactgcattccagcctgagcaacatagtgagaccccatctcttaaaaaaaaactgaagtgggccaggcgtggtggctcacgcctgtaatcccagcactttgggaggccgaggcgggtggatcacgaggtcaggagatcaagaccatggtgaaaccccgtctctactaaaaaatacaaaaaattagctgggcgcagtggcgggcacctgtagtcccagctactcaggaggctgaggcaggagaatggaatgaacccaggaggcggagcttgcagtgagccaagatcatgccactgcactccagcctgggtgacagagcaagactccatctcaaaaaaataaataaataaaaacaaataaataaataaaaaaaatgaagtgaacactaaaccatctaatagataaaccattcagactattcctgttactgcactcagtagttttagttacaaatgatgacaatcaaagttatgttccatggttgagtgcactttgtcttatttgtatgtgaaaactcacacagtaggaagaagttctgtattggttaactgagttctcaactggagacagcactgacttccccatttccctttgcgggtaggtggcattccagattatgtggtggtaagcttttcttttgcggggagagaagacagggcagtactcctgatacctaataactatagagcagacatgttaaacaccctgtaattatcaggccacttccccaactgcagaattgcccatctcacgtgcacacacaggacccatgttgagaaaaatgaagaaactgatgccttattctttaaagtagttataagttgaagatgtagacctatcttggcattctaaaattctgtaacaacccttctgaaatgggtgtaataaaatgtcaacaggttaattggttcgtgatcactgtggcttaaaaatctagttaaaatgctaagacttgtgcacagtataggcaaagtcacttagattgtttcaaaaagtatgccttatagaaataaacatttgacatacataaataacccttggtttacacataactcgcatttgagaaatgaatgtgttgtagatcatttagaatctttttcaatcaaaaattgaaagaaatatttcgtcacccaggtcaaccagagattgctggttttactcatgatacttaagtagagtatgatagttactatttcaccttcagctgtacttaagatgttttcctggaaaaattcattctgctttctgaccaggatttccagaaactctgacccttctaagaggtctgggtggaattgtgatggtgattctgctagtagacagtgtaacttctgcgtctacaaaaagaggataggccgtcactgctcacatggctttgcgtgaaagcccaatggtactgtctctatggcagagatgaggaaggaacaccagcgtcctccaactttcctgttcttcctttgggttaatggccactgtaaggaaacagttttctgccacgtgtggggtgatttgaatgtaaaatgcccaactctcatagcaggctgaacagaaacattttttatactcattgttaatttgttctaatctaaattacttttagactattaaatattattctattttaaagttaagggactaatgcctctgataacctgattaaaaaaaaaaactttctgatactcagaagttaagatttattcagttgaagatcatttctttcaggtgttgatcgtgtgatatttttcacatctgtaatctgaggttcatatgaaatgatagtgaaataaaattgttcatttaggtctttttgtcatgttaatatgttatcaggttaatgggaagtttaatctagttaatgtaaaattaataaattgtaatctagtttattgcttttttggaaaagaatactgaaaacattgtttacttaatacacatgacctgaggtaataaagaggagctggcctttttgaggggggaataatggcagtgaataatattatctaagacagttttgccagctttaaattcctggaagttcatccaagaagtcctgatccctgtgttcagtaaaatcatgtgagatcaaaatataattctgattttagatctgacaaattctgtatctctgttacaataggtacgacaacaattccacgatgccaaattcatggcagacattgatctggatccaggctgtacattgaataaaaagattcgaaatgcacagttagcacagtataacttcattttaggtaagaatggaaacttaccaaagaaaatttgccacacctcaggaaaatctactgaaaccttgagacaggtttaagtgaattgtaatcaagaatttatttagttccttccagtcctgattttttttctattatatattttaatatataataactataaaaataggctcatgcatacatactgggtttttttttttttcacttaaatcatggatgtctgtgagaaaatattttgctattataacaagaatgaagacgcattgcttttaaacacatctattggattactttctcaagataatgccttatgtgggattacttgaaaaaagatattcatgatgtttggggttttattatttggttgttacgttgtctagattgactccataagcacagtagttttagatattgcaaagagtttcttttaaatatcaacacatggtcacttgtaccttttaatgtatcagaagctatggggtaggttttgggtcctaggatcatttcttttcagatgttcagtgtgaattcttccatatctttagattaagtctgacaaagctttgtgtgtttgttttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataa

SEQ ID NO: 2219 - DNA, 27316 bp, Homo sapiens; identical to SEQ ID NO: 2218

SEQ ID NO: 2220 - DNA, 27316 bp, Homo sapiens; identical to SEQ ID NO: 2218

SEQ ID NO: 2221 - DNA, 27316 bp, Homo sapiens; identical to SEQ ID NO: 2218

SEQ ID NO: 2222 - DNA, 27316 bp, Homo sapiens; identical to SEQ ID NO: 2218

SEQ ID NO: 2223 - DNA, 27396 bp, Homo sapiens
catgattgttccacataaagtcagaagggaggaaaggcgcacgcgcattggggacttgactctggaaagcgtccagaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccggtgagcaaacttggtgggacccagagaccagcctgggactctagtgggtgcagacgctacgctcgcggcgggagcggggggcaggaagcaggaagcggccgggaccgcgtgggtcggagaagtgggggatggtgggactcctggaaagtcggaaccccctttgggaaccatccattcataaattagggtggggccttgcagttcatctgtgggtccattctctttacagatgaggaaacagaccttgagtgagcgacttgttcagagcctcacatctacagtagttagacgcggagacagaatcagaatcttaggcttgaggcttccaaacttgcgtttatggcttactgtaagcgggaaacacattgcagagccttatttaatcaatctcctaagatcctgcgggggtaaagagctccattttaaggaaaggaaaaccgagtgcccgagatctgacccagcttgtccaagtttgggtggttaagtatacattttgcccggcactgatctgggcggtgcatgtgggaagatgaatagggcccagttccccgactttgagggcctcacaggctgatgtgtaagagacaggaaaacagccctagtgctttgtgatcaaccttgtggtattacagaagaggaagtttaggaaggcactttagaatttagtttggaagaatgatttcaccaggtaaacaggcaggacggggcttcccacgtaaaggtagggaaggcagtgaaaaggggcacgcaggtgaattgtctttcgggttgtttgcaagagatatgccagaagggttaaaggaacagtaatcagaaggatcttaggcaacaaggatgtttgaaacttgtattctatacatgaaggatcttaagcaggaagattgtatttgtaaaagtcacgctggcattgggatagaaggttaggccacatgcagaaggctgttgtaatagtccaagtgagaagtggtgacgtcttcagctaagggatcctctatcccaagtctgtgacaggacagttcacttaaaagccaaatttttttcttgattgtccactcgagattgaatggagaaactgcatacgggcacattctaactatgtaaatttaattctagatgataaatggtgactatacgtagatttttttcacataaaatgatatttttactgttttgtaacttttttttttttttttttttttgcttaatagaatgtggtcaacaactttccatgtccataaatattctcctgtgctattcttaattggacgtgatatgtatggttaacacatatgtaatttttccttcctgtaataattatacaatagttaatatttattttgagtactaaatacgagtttggcactgtattaatgcattccatgaattaactcattcagtcttcttttttttgagacggagtctcgctctgtcactcaggctggagtgccgtggtgcgatctcggctcactgcaagctccacctcccgggttcatgccattctcctgcctcagccaccaggcctggctaattttttgtatttttagtagagacggggtttcaccgtgttagccaggatggtctcgatctcctgacctcgtgatccgcccgtctcggcctcccaaagttcttggattacaggcgtgatccaccgcgcccggcctcattcagtcttcttaataacgctgtgaagtgggttctgttattatctccattatacagatgagaaagcaggcgtaggaacagtaacttgctcaaacccagtatccccgtttttttccttcctcaaacccagtatcctatagccaatactaataacccctgtgctgttctgagtgagtcagggacagatcattcctgagaaaggtaattctgtagcttctcttcacaatccggttctgtttcccaacttttgggttgagattttagattacttgtatgtagatgtacataccatatatactcagggaaatagagaacagttgcctactctcttcccagtgttgtagaaaaggggtcataggcctcagggttccagagagacctgttgtaatttcccagctctattacttaatgatacaaatgggcaagttacttctttgagccagtgttcttgtttgtaaaatggagccgtatttagaaccagaaaacctttgtggtgattccctctctctctctccctctctctctctctctctctctctctctctctctctctctcactacccctgttcatttggcaaatggtcaaaaccaaaataatcttatcagaaatataaaacttattttatcatctttccattttaaacctgcacagacctgcaatttttctttctttttttttttttttttgttgtcgttgttgttgttgaaatggagtcttgctctgtctcccaggctggagtgcagtggcgcgatctctgctcactgcaagctccgcctcccgggttccagccattctcctgcctcagcctcccgagtagctgggactacaggcacccgccaccacgcccggctaattttttttgtattttttagtagagacggggtttcaccgtgttagccaggatggtctcgatctcctgacctcgtgatctgcccgcctcggcctcccaaagtgctgggattacaggcatgagccaccgcgcccagccgcaatttttctttttacccagtatacttgatcagttacatcacttctgcagtataacaaaggctctattgaatctaaatgaacctttaaagtttattaaatccagacttctggagtaggggggattttagctcagcatgaaattaggagtcatattttaaaattagttttttttttaattatacaagtaacgcattttataggatttaaaagacaatggccaaaatgtccatcaactgataaatggataagtaagcaatggaatattatttgataataaaaaggtacaatgacaagtattgatgcatgttacaacctgatgatcttgaaattattatgctaactaaaagaagcctgtcacaaaagaccacataatgtgtgattctatttatatgaaattcccagaataggcaaatctatagaaacagaaactaggttaatggttgccagggtctggagatgaaggcaacagggagtaaactgctaatgggtacaaggtttctttttgagggtgatgaaaatactctaaaattgatggtagtgatagttgcaaaacagtgaatacctaaaaaccattgaattgtgtactttacatgggtaacttgtatggtatatgaattgtatcttaaaacttaagaaaactaaaggtcacaaacatgcaaactaattaaaatccctgtttacattcctggcacaggatttattactttaaaactttctatgacttcacttgcttctaattgaagtctgtattccttatggtaacttttagttcttgcttctgtgagccttagtctgtcttaccttgtattactttctaaaacaatccttcattaatcagcctggtttagtcattttttctctctttaaattttaacatttctgacaacaagcttatgtgtacacataggacacatttcctgtattctcagaatccacctgttgaaatgcattccatcctttaaaacgctagtcctagcttatttgacatctaatcgtagcgttactactgtgttttctcctccgggagtttctcacacatgtatgccttactttccctggagagactaggtttacacatggtagggattgggccttatgtttgcttcttccatggcttttgttagcactggtggaattcatgggcacactttgcattcagtttttttttttttcccctggaaatatgcttactgaatcaactgcgtgcttccttgtggccatatgtttggtatgtggtccaagtaaacctgaagcgagagtcacaagaatagttaaaataaaataaatgaaatttgaggagttaaacatcgttagtaactccttcctactttttaaagacttgcctttattgtaagttgttaacctgtctttgccagtgatgaaattgttcagtctttcaatatcagatttccattttttttaaattaaataacaaatactaaaataacattctcaacacttcctggggcatcacaggatggaggtgtcacattagattaaaatataaaacgttttttgcttatttagattggtgctggtgaagagaagcaaaaggaaggaggcaaaaagaagaacaaagaaggatctggagatggaggtcgagctgaggtaaaagttatcatcacagagggctctgttatcagaggttggcaaatcgcagggaactttctgagactttcctaatgtgtaagggttctaatggtttacatggtagtgtaagatggtactggttggaaaaatcaggaagaagaattaggaaagggtaatctgagaggggaaaaaagactttcagttgttactgtaaaaggaagcaactggcgtatgattgtataagatgatctgattgtagggttgaatataaaaatcagagaacaaaagttgaagaggagactggtaattattcagttgccagatgtgatgccagctctgacatttcattaaatgagatgttagggaatagagacttggtgtttgggcttacactgaatacaatgaaaaccaaagaaagccagttttttgaccccctccttgccctttccatctggacctgccctagggttggcttctaagccaggacagatccccttaaggcctctcaagtctgcagaaaatgctttcacttctccaggctcacactgaaaggaactggcatatcaaaagccagccctaaatcaacctggttcctgagtattttgcttttacaggcagttaagcttgcctttctactttatttttactgctgtgaactgtgcttcactttttgctttagtcattacagctgttttattggagactctttagaaagctaccagaaggaagaagcacaaaggaacagcctttttagaagtagcacagtaagctggcttttaagagccacttttacaaatgctgcaattgctaaatttatagtgccgtcatttactttagggtaagtttatagatgatcaagtgtagtgttgcttagaaccctacctaaccatttatcttacggctgatcagttgatcagtctcccgaccattatacccccactgtaattgtgaagaaaattgttgattgtgaattttaaaatttgcaagccaatggaaaaatgcatatgttccctaatttcttttttatactttcaatacaaacatacgtgctgttccatcacagcttgagaaatgacctggaaataagacaaagagtataattagaagactcttctgaacagagaattttaagtgggacatgtgattatttatgtttaacgattggtctggaaaaaagagtgtacagtgaactgtccaagaccttggtcttcccctccaagggcaacttgcaggttttattcatctctgcaatcacagagactgacacagagggtatctgctgaatgaatgttgaagagattttgacacgaaattctaattgggacattgcaagtggctatgatgataaactgcagttaagatacagagggtggtgcaggtgggtaggattataatgatgctttagagtggatggaactgggtactgtgcattagtctgaggggttcagattatggttgtagaatgacaggctctgtctgagcttttagttaattcatgggttcttcaccattgaaggttatggaccgttgtgataatttgatgaaaagctctcaacaactgaacgactaaagaaagggagggactgctgtgggtgggaattacaaagatattagggcctgatacggtggtaggaaccaatcacttgagactgagtgggagaatcactggagcccaggagtttggggccaaaatgcgctgtgactgtgcctgtgaatagtcactgcgctccagccagcctaggcaacatagtgaaaccctgtcgttaaagaatggaaagaaggagggagggaaggaattactgggcagacaattaatctttttcatttgatattattttctattatctccagtcaattttgttttgttttgttttgtttgagacaaggtctcactctgttgcccaggttggagtgcagtggcccaatcttggctcactgcaacctccacctcccaggttcaagcaattcttatgcctcagccccacaagtagctgggactacaggtgtgcgccaccacacctggctaatttttgtatttttagtagagataggattttgccatgttggccagggtggtatcgaactcctggcctcaagtgatccatctgccttggcctccctaagtgctgggattacaggaatgaaccaccatgccctgccccagtcagtttcttaaggattagatattcccttgtactcctttcaaattgtggtatgttgatatatatggagacatatgtatggagacgttggtagcattatcaacattgaataaatgttaaaatctgtattgcagtaagtcattttatatctgatagattgaaattcatttgaagatagaaagtcatggcaaaattaagcaatctcctcttcacttttgtatgaagtgttaatgttcatgtaatttgaagatgatgaatgctgtagatgttagtttgactgttttgttaccacagattcactgcctttttgaaatgttccatagattatagagtgacagtagaagaagtcagctctctgattgctgtctctttttctttctttgccaaacctctagaaacctaagtgggtgttttatatagaatatttttgttaattttatctgctatagaaagtagtagtgtgttgttttatatagttgctaattacatactccaagctgatcatggcatctttgaattcagtaaatactttccttgaaggggagaccttaagtcaaagaaatttgtgattggttgtgagtggacatataggctgacccgctgcacagaccatcacctggacatgaatgaaacaaaatagaaaagccagtttattgtttttatttccagtattgtttatagctctatttgtaaaataatttagttagaaaagatcctaagaagacatcttaaaagagaaaagaccacttgctgtaaatagtagcaaaatggtaattgtcgattcagcataagaatagggcatttaattccttcttttaccttcatttagaaccaaattgaggtaatgccgggtgattttggcagtgtttatttaccacattgaatcaatagtcctgggtttctgtattgtttttattatttctttcccatttctaaataggaaagcaatatttactgatcatttatttcctgatttgtttgttgtcttgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattaggtataagctacacccatcatgaccttccatagtttgtggtctaactaaacttccttttattatcttgccatgttttattcttataatatttttatgttaccattcagtgtttttaatctgtttaatttgcctacttgagattttttaaaaatcaaaatgatacagagctttgtagtcaaaattcaaagttaatttctgaaagagtttactttggtcttatcttttggggcattgtatatttttagtcttactatgattataaatgttacaaaaccgactagacagtgtttacctatttcgacttaaatgtcttggttttgaagttaaaaatgaagctacataatctcacatggaaaggttaagaaacttcatataacacatgaaaaaaatgtactatttttataaattcaatgaaagactattcctagtcttaaaacttttattggggtgggaagaagttatttcaattaactgagaattagatgcatattttgtaataggggagaggctttcttaatctgatatgattgggatcaataattggtcagtttatcaaaataagagttggtaaaacatatatatgtgtatatatatacgcgtatatatacacgtgtatatatatatatcttaaactgggtattgggaaactctagtcataatctgtttgtgtatgtcctgaaagcgaaaaataaaaatgattctttttttctttctttttttttttttttttttttttttgagacagagtcttgctctgttgcccaggaggctagagtgcagtggcgcgatcttggctcactgcaagctccacctcccaggttcacgccattctcctgcctcagcctcccgagtagctgggactacaggtgcccgccaccacgcccggctaattttttgtatttttagtagagacggggtttcaccgtgctagccaggatggtctcgatctcctgaccttgtgatccgtccgcctcggcctcccaaagtgctgggattacaggcgtgacccaccgcgcccagccaaaaatgattcttaaatttttaaatagttggaaaaaataaaacaactaagaatatacaacagagaccatgtttggcctgcaaagtgtaaaatatttgtgtggccttttacagaaaaagcttgccaatcttggtcttaaacacttcaacttaaaatatgtgaatatgtatgtattcactaactttatatacatacataaaacagtgaatatatatatgtatggcaaggtttgggggatagcgagtgctaattagagttcttacattatcttaacacatacgagaagtagtctgagcacagaatccttgcagattttcatgtagttgtagagttacacctaacttgacagtgtttttgtgtgtgtgacttggatttatcaagccttctcaaacattcaacttggttttcatagaatccataattcccttattgtgttattttataattatatatttttgaagtttatttataagtgttatgtattgaattgaaccatttggaatcaccatatgaattgtcatgtggttgattatcatcaattttgtattgttgaaccaaacacgtaaaagaacaagcacaaaaacagtttggggaaccaacgtggctgattcttggtaagcgtattatacaactagtagaagcagaaccagttaggcctatgagccatgagcatctactgtaccacagacattagttagtactttttacaaagtgaatggagtgtttccattcatttgacaagtgcttctacctacaagttcttctaccttactccaaaggaagtaaaaagttgtaataccatgcaagtttctatgtgagagcatagagaactggatagacctttacgtatcagttcaacctttcattttagagataattttgaaggtcaggttgattaatagattcctctgttgtcacacaatgagattgtagccgtgtcattaaaatttaggcttctgttagtttgggaactttttcctctaccttctacaatgttgatctagattacattgtaatttatcaagtcttcagttgaaaaatattcttcaagaactataaaattctaagttgaattacatagctgggcgtgttggctcacagctgtaatcccagcactttgagaggccaaggcaggcagatcacctgaggtcaggagttcaagaccagcctggccaacatggcgaaaccctgtctctactaaaaatacaaaaattagccagtcatggtggcgcacacctgtagtcccaactacttggaggctgaggtgggaggatagcttgaactcgggaggtggaggttgcagtgagccaagattgagccactgcactccagccttggtgacagagcgagagtccgtctccagggaaaaaaataaaaggttgaattacataaaacattgatgggctttagctctggagttaagtcactgatctgcactgagaatactttatgaaatttttacaaaagtccagaataactttttgttctgtgaaaaattataacattgataacaggctatttaaagattcacataattagtggtgaatatgaaagggaaggacaaaaaagacatgttccatttgcgtcaaaaggtttttctttgaagttttgttataaatcttttttttttttttttgagacggaggagtctcgctctgtcgcccaggctggagtgcattggcgccatcttggctcactgcaagctccgcttcctgggttgacgccattctcctgcctcggcctcctgagtagctgggattacaggcgcccgccaccacgcctgcctaatttttgtatttttagtagagacggggtttcactgtgttagccaggatggtcttgatctcctgacctcgtgatccacccgcctcggcctcccaaagtgctgggattacaggcgtgagccactgcgcctggccgttttgttacaaatcttaaagattattttacccttctttgaaaaattgaaatgatccagtatggcccatgtgtaatctacattttcagagtaactctattcttagaatcttggggctccatattggatcataagataaaagtcatgttcttcccaaagaatatagagaatatgattatcctttttatcagttctttaatctcctgaaaactgttttacaccaatatgatgaaatacatttctctctgccaaattcatgttatgttttgtgaaatgcatgtatttattttattgactccatctgatctcaggaggaaagaaaacattgtttataacctatggtaaagttagtaggagcattgaaaatagaaaggagtttgttgtttactttctgtttggttcttttctcttgatcctcagataggagttgtatacattttgttgtaaacccttagacatagagagccaccaacacagcaagcctggctagcttaaagccttctagtggtaggtttctttgagatttacagtgtaaagggtgtatactttttcttcacagtgtagaatgttgcctaccttcgttgagatgtccaggctgttatagactattatttctctagctgtgcatttagatgtataatctggctcacctactcaactctgctctagtcacacagcttcctgcaaaaacctctcttcacttgcatctctgcttgcatctgtggccattccctcatctggaatgccatggcctcctcttttcttcctgtgagtgctttatcctcaaagcctttccagatgactctgacctgtactgctttccctcctcagaactcctgtagcttttacactctgtgtgctctgatatttcatcacttgatgatactttatgttcgatgttgtatattgggtgtgtaatgtttttactcacattatatggaaagttttattaaatagtctttcattttacctctatatttgttataaatattatcataggcatttgcagaatttattctgaggttagcattgtctgtcaaagaaaggatctggtgtacattttaagcaggaagaggaacagagaagttatttagtaggccttttttttttcctttggagtctacatagcttagctttgtagaaagagaaaggtgggtgtattaagagaaaactcggtgtggtgacttgtgccagttgtcccagctactctagaggctgatgttggaggattgcttcaggccaggaggccagcctgcgcaacatagcaagaccctgtcgctaaaaaattaaaaaaaaaaaaacttatttgttggagaaattaagattattcaaaccattggaaattgatagtgcttatttatcagagttgccatatctgcttaaacaggaggcattcaatgtcaaatgataatgttctgcattttcaggatcttccagttaggttcttaggtacatttttggaatttgttgtttttatcattatatttcagaaaaatagagatacatcaatataaaaaaacaatatataataaaaatagtgtttattttcctgttttcaaattagattcgtgtgtacttatatatgtgtggacttttttttttttttttttttttaagtcaaggcctggccgacaacaccgttattgctaaagtaaataatgttgtgtgggacctggaccgccctctggaagaagattgtaccttggagcttctcaagtttgaggatgaggaagctcaggcagtaagttgctgattagtattcattgaattttaggatgcagattcacatttgaagtcttttccagctcagtcctgctgcgattgggtggctaacatttattgttgtctcactgtcatatttgaaatcttcattttgtccttcatttagggaacataataaaagtgcttgccttagaaaataaaggggtgaagctgaataagtcttttcattactagacacttcaatagggaaaatgttttgggaattgtattaaacattgattaagcaagtaaaaattgttttctaaactgtgaacactattttattttaattttttttttttttaatgatggagtcttgctttgtcactcagactgtagtgcagtggtgcgctcttgcctcagtacaacctccacctcccaggttcaagctattctcctgcctcagcctcccaagtagctgggattataggagcgcactaccacacttggctaatttttgtatttttagtagagatggggtttcaccatgttggccaggctggtcttgaactcctgacctcaagtgatctgcccacctcggccccccaaagtgctgggattataggtgtgagccactgtgcctggcctctaagctatgaacactctagcaagatatgtacatttgacaaataaatttgaaccttacttcaaagcactgcctttattggataatttctgtatttttttctcatcttaagatgcaaatctgctggataacactataaaagtcaacctgcatgtgatgacaagattttctttttaattctccatggctgtgtatcatataaggggagacaaagtattttgttttagtgatgattgttcacttatgtatgtggattagtggttttcaaatgtattttggagccctcaagtttcttacgagaattttttaatgtcactttggtaccttaatactaaatcttgaaaacattgctttgggtgtattctgactcatcccagtgattactttaaaaccaagtactgccatttgatttcagtgtacagatgtttgtcctcgtgttttgtcattgtgttgtggggtcgggttgtaccacctttgttttgggccagtaacaacatgtaatttctaagtgatgttccatagccagctaaaggccagatcacagtgtctgagacatggtgctgtgggcacattgactcaaaagaacctgggccattgcaatcaatgagttagtcacattgtgagtagcagttgttttcagagaacaaagtctatgtcatttaattagtgatgccaagtttagtttaatttgtttgaaaacagctaaaccagatgatttccaaaataaaaatacactagtaattggaagccttttgaattactttggctatggatagaaacagtagtttatagatttagaaatttaggattttatatattgggtttacttgtagtaaatattatcatctgtctctttcagacaaccacattaattggcaacttgtatgccaagactcagaccatgccatttttctttaaattttcaggtgtattggcactctagtgctcacataatgggtgaagccatggaaagagtctatggtggatgtttatgctacggtccgccaatagaaaatggattctattatgacatgtacctcgaagaagggtaagccatcaactagataaagaaaactgaagtcaatgactatggatccataagttattcttaagagttctcagtaagggaggaatgatatagatctcactgcttcttcatcaggtatgcccattatcagtacttgaagtgttgcaatttacctgaagtaatagaggatttgatgagacctctgttctagattgatggaggtagagtcctaaggtattttgggaaattcagggagactggtcctcccctctcctttaaaacctggtgatagagttgcgggaaggggtcactagtgagaaaggtctccatggatgaccaaggtagaagctactgaaaatataaaatgtaaaaattacttatgaaaaatgttttgtttagaattctaagatacgatgcaatagtctaattttttaatattaaaacccttgaagtattccaaatactatttccaaatgaacatttttcgaagccatggtgtgattcgaatggaatgaaaagattatactttcttctccttcaggggtgtgtctagcaatgatttctcttctctggaggctttgtgtaagaaaatcattaaagaaaaacaagcttttgaaagactggaagttaagaaagaaactttactggcaatgtttaaggtaaattgaaccatagtgcgtggcccccactgttaatatcatttattcatgttagttgaagtgacaccactggcgttccgtgtactaagctgaagtctaattggttctttagcaaaaattaagtgtttttattatttttttaatttcatttttttcctagcaaaccattccttcaacatgtttttaaaacatgaagtatcaacatttatattcatacagtgctacgttttagctatagtacttagaagtaaaaattaaaggacagttttttaaaataataatttttcctgttttcagtacaacaagttcaaatgccggatattgaatgaaaaggtgaatactccaactaccacagtctataggtaagaatattagatgtcattaaatgtatctggtatgtatgtcattttgtctttgttaaaattcctttcattttatctttagatgtggccctttgatagatctctgccggggtcctcatgttagacacacgggcaaaattaaggctttaaaaatacacaaagtaagtaatgtaactttaaagactgtgaatgtatctgtctagaatagatatatgtttaaactttcactgatttctctttaccattttctgttgcacatgaaaggatggtattttctcatgctctctattaactgggagctgtatgccatcaggattttataattgaaatccctcaaggggtgactgacttgctgtcattgccagagcaatcacaggggatggagattttacaaaatcatacagcatgggccatcctggctctataaaagctttgagactcactgggagtatgtgcttttgccctttatatgtctaaattaataatttcccaagttgttgtttttaacagaacccagttttatactagttcataaacattttatggaggtttttaaaatgcactttaaatcaagagaataattgagtcatttcaagattttttttttattggctcatttctatttttgctcattttgtgagaaatgcctttgcaggcaaagtaatgtttgtggaattgtggttgagtattgaggggtgggcagttttgggggtattggggtgtagaatgggtctcactctgttgccccaaaaagacagagtggaggaccacttgagcctgggaaatgaggttgcagtgaatggagatcgtgccactgcactccaggctcaagcagtcctcctgccttagcctcctgagtagctgcgaccataagcgcacaccaccatgcctgggtaattttcttttttttaaataaagaatggggtctccctgtgtttcccaggctggtctcgaactcccaggctcaagcaatcctcttgcctcggcttcacagagtgctgggattacaggcatgagccactgcacccacctgcagattgagggaggggcatttttgaggatagaaaacagccaactttgtgctgcagaatgagtaactactctaacaaggcctcaaagcaattgggagttaaaataagtgagatgtttacaaatttgaatgttgtttcatggttaatccttgttttcagaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggtatgttcaagaacaatgatgtgtcttgactgagttttcttcaacttcatttgaagtttgaaattcagctgcatgaagtactaggaattttgttttgaagagatgttgtggctttttagtaactggtgctatgtcctgtacaaactataaacacttactgattgtccacattatctgcctggagtatgctcagtaccgcacaaaaatgcatttgaactacttttattgagagcaaacactgatgatctacggttttctgtaaaagaagtataacagcttctcatagagctgggagaactatggaaaccctctagtttcactgactcatttaaaatgtggaaacagagtcccacaaagattaacctacttgttgcccaaggtttagcagcatgtcgcacatggatcctgtgctatcatttcctctacccattatctctgttactgctgaatgtcctctaaactggaagttaggctagataaaacattcccccttaaaataggcactctgtgccaggggtccttggctattaggttatgaagcttgagctggaggtagcagccactgccttgcacccctgactacctgacattccagctatgaggcagccagcaatgattgatgggcccttccctgagggcttttgggcacttggggaggcggatgttggcaaggaggtaggagggtgtgtttctttcaccatgacccaaagtcagccaactttaccatcatctatttcattatcagtgtctttttcccagtctccttcctgatactcttactaagaaaataaatacatacataaataaaatgaaaaaagatccagatcttggagctttaaggaatttaagaaccatgagaggtactgcagtggatagttaaagaactgaagggacccttattccctgccactgttggggaaacttgactggattgaggaatataacaggcagggcatgtgttacacgtctgccaaattgtaaatcagctgcaattctataacatcagaaacactgacatggtttctttgattcaggagtggcactgattgaaatatgggacatcatgaccatattctgagctcaagaacactgaaatttatgtatatatacacacacgtatacgtgacgtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggtctactaaaaggaaagataatctgtatttgagaagaaatatataagacgataagtaaaagtagaagtctgtggcctcataaatcatccctaatagttgattttgcccatatacacatagaaactggtgagcttgaagggggacctgtggtccttgacataggagctctgtgccctctttgactttgatcatttatttgtattttctttgaaaaaacggtttttacattgcttttttcctttgtaaattatgaaatgtttcaagtataagtttatagagaatagtatatccaatatcttgtacttaactacccacatttaacaaatattcacattgggctatatttgcttgagattttttcattcatgatattaaaaaaaaaattagttgtttaaaaagcctctctttaggacccagttttgatccatatacctccatatactggtatatatatccatatactggtatatcatataccagttttctagaagaaactactgttttgaagttggcatggattctttttgtccatgttacttatatctagcccatgtatttgtacccttaaattatttatgtatttgtgtgttacatataggaagcctcattgtgtatcagactgccttgtgatttatttttagagacatgcaaatcaagtttattttcacttgctacatattattttgttatataactaccacaatgcactcatccctgtattgatggacactgatgtataattgtcccttattatcagccatgctgcagtagcatcacttttataagcctccttaggtacatgtgccaagagttttctctctggtatatacttagaagtgggatttctgaatcatggcatgtgtccatctttttcatgagagagtataaaatcactctttaagtttttactcccacttgaagtatgagcatttatttgcctacacatgtttctgtttattttctatcagagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactggtattcggcagctttgaatttctactgaagattttcacatgctacaattcatcctgggttcttccctcctttaacaacattttcattaaaaacaaattatgtgatcagaagagcatttaaacgcaacatctttgtattatatcttctgcacctgattagatccccactttttttttttttttttttaaagaggtcttccaactggagtgcaggtatgcgattatagctcactgcagctgggactgcaggtatatgccaccatgcccagctaatttttaaaattttatttctgtagagatgaggtcttgccacgttgctcagcctggtctcaaactcctggcctcaagcggtccttcaaccttggcttcccaaagcgctgggattacaggcatgagccactgtgcccagccagatctccagatctgtgggcattcagtaatggtactgggatcatagcaatgaccaaggcagactataaaacaggaagatgaaatatgggggtgtaacaaattacctagtgtgttgttgttttaaagaaacctgttctgtcaaaacctgctaatgactcagcattcttggaaaatgttccttgtcatgaggccgctctgctttctatctttgaaagttgggtgaagaacagcttaagggaagacacaggagagctgtggatacaggtagcttagtgtctgcagctcctactagccaggcctggagggcagaggaggtgagagaagaatctttgtgaagaagctgtattataggctaggggaccaaccaagttcattcttaattttcccagattcttcagttgttggaatacgttttttaattcttcactgtggttcattgagttataacttatttgctgttttattcatgcaagtgcttttactgctgtatgtagcccagaatttgagaaatgttgcttggatggacagctagaatcagtggctttttgacaacctttcgtgtaattaaatatagcattacagaagcagttttattcttaagtgtccgtggacttttctttttctcttcagccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcaggtatgagaccctgggaataaaatacttagaaagaagagtcaagaaagtcaaggaaaataactactgtttctttttttgttttttaatttgaagattgaagatgaaataaaaggttgtttggattttctacgtacggtatatagcgtatttggattttcttttaaactaaacctttctactcgcccggaaaaattccttggagatatcgaagtatgggatcaagctgagaaagtaagtggtgtttttcagcgtgcttttgaatactgtttgaaattggcttgttctgagatgtaagaaagccaagcctctttaaatggataaaagcaaaatgaaattggaaatggttcctaggtttgtgtaagctagtttttttctttatgattgtgtatttttgaaatggttgaatgttttcatgacttttttcagttatcaagctataagctttaaaaaggggttggtatgagcatatgttcaggtggacaaaattctaaagcagagaatattgatctatgaaagtaattactgtatttttagtctcaaattaggctaaaagaagggaaattgcgatgaaaaaaataaaaatcattttgctttatcctcagcaacttgaaaacagtctgaatgaatttggtgaaaagtgggagttaaactctggagatggagctttctatggcccaaaggtgagcactaaagtacatttgggtaatatgattttcacttgtggatgaagaagatacgacttcgaaaaaagttggaaaaaagaaaatcagccctaatccaactattgagctccactttagtatcactggcattttataataacccagtctttgcttcttagattgacatacagattaaagatgcgattgggcggtaccaccagtgtgcaaccatccagctggatttccagttgcccatcagatttaatcttacttatgtaaggtgagtttctggtgtctgctctgaatattctccagggatatataagagaaaatatatataataagacaaaacaattttttttttctttatagccatgatggtgatgataagaaaaggccagtgattgttcatcgagccatcttgggatcagtggaaagaatgattgctatcctcacagaaaactatgggggcaaatggtaatttttgtcactgtcttttttttctgattagtataaattggctacaagaaatgtctacttttcgatttaattatcagatggaaagggagaatgattccaatcggttgcttctaactaacgacaagtgttcattaaaaaataaggaatcacaatctaaacacaaactttttagcattaagaacaattgctaatagtaattactttaattccagaacttgatttgtttggatgttgtgtaatactttctaattaggaattagtattctgtaagaagtatacttactgttttggatgcttttctagtaactttgttttgggatttagatggctttgctggttttacatagataaatgaggaggcttatggctttcttcgttcagccttgctaatcataacaagcaggtatttggacatgttttaaaagccaagcattttttaaaacagatgccaaaccgatcaacatttgtgattcatttctgtgaggttaagtaagtttttgtttccaagatacatggccacataactttcatcttaattcttaagcagttttttctggacccacagtgcatttgaaagcagcacagggttataaaagcacccgtgtgtagagccttccatattaatcatattgatttaaaacttttgtaaaatgacgtacattggtttaatcttacacattactgtcatttcagttttatttgaacttggttacttcagaaattaggacagtttctcattctgatcaatgatacaagataatctctagatttctcaaagtcagataaaatgtgagacacattctctgcaaggtatttcaagaattaagggagtcctcagctaattgctctgctaaacctgttttaggtggggaaaagtccatgattagggtagaatttagtgcctactttagccttttgcctgatacaacagaacaactgaaaatagaggaatgatggagaaaaacattagcctgatgtttgcagcatcagaagcatttgacacttgtattgcttcaaagggagaattggatgggcttattttttaataagtagtgaaaactctgatttttaccaagtgccataaccagttattatcaattacaatttgctgaatgatacaaaatggatgttgagtaaactgagggcactgtgtccccgtgaagaataagtaataaaatgaacaattaatcactacatgcagttattaaatcatttgttacctcctctcacagccaatacacagtgttttgtgatgtattaaagtgtgaggcctagtcctatcctcaatttgctttgctatctacttagcaagacaaattgtagttacaggctttccttacgtagggttagttttcttctcctgcatctcctcgccttaatctttattggataggtcttttcattttggggttttttaaagccaagttttaaaagtagtcgttacatgttccaggaaaagatactgaagagtagagtaagaaatatgctgtccctgtttagtgaatatgcccacatctacactgaatatttttattctcttccaaaggcccttttggctgtcccctcgccaggtaatggtagttccagtgggaccaacctgtgatgaatatgcccaaaaggtaagccttagatatgaattttctttcaatttaacatctgttgttcagcttttcaaatcacataagccctgtattcttggtgaatcgagctgttgtgataaagagaaatgttactatttttaatctttgttaagcctgaatagattatattacttctttaatgcttttctccatgattccataatcagaagacatatttggatagtgttttatgtacacttgtatattttattgtatttgttttaagagatgggatctttctcttgccccaactggagtgcagtagtacagtcatggctcactgtaacctcaaactcctgggctcacgcagtcctcccaccttggcctcccgagtagcagtgactacaggcaggagccaccatacccagttacacttgtatattttagtatttagtattttaaaaaaccagattagcagatatcaggtacttcagtatggtaggtaaattcccgttcaaaatacagtttaggctgctctttgactcagtgagtaattttgcttcattttaatgtaaatttcttcaggtagttgaaattttttcaggttaatagtatagcagaccaatgtcttgcctctctaccaaaaaaactaacttaccaacaaatgtatagccattcataacttcactttaaagcattgttctgccatagtgaaaattccatactaaggaatttcaaattattaaaagttgatgagtgaacaatactgtaacatcaaaaccatcatgtcttcagaccatcagaataaaccacactcagttcttaattacccttaagaaataaatgaacttgagcatggagatgcatacctgtagtcccagctacttaggagcttgaggcaggaggatctttgagggttcagggtgtgatgattgtgcttgtgagtagccactgcattccagcctgagcaacatagtgagaccccatctcttaaaaaaaaactgaagtgggccaggcgtggtggctcacgcctgtaatcccagcactttgggaggccgaggcgggtggatcacgaggtcaggagatcaagaccatggtgaaaccccgtctctactaaaaaatacaaaaaattagctgggcgcagtggcgggcacctgtagtcccagctactcaggaggctgaggcaggagaatggaatgaacccaggaggcggagcttgcagtgagccaagatcatgccactgcactccagcctgggtgacagagcaagactccatctcaaaaaaataaataaataaaaacaaataaataaataaaaaaaatgaagtgaacactaaaccatctaatagataaaccattcagactattcctgttactgcactcagtagttttagttacaaatgatgacaatcaaagttatgttccatggttgagtgcactttgtcttatttgtatgtgaaaactcacacagtaggaagaagttctgtattggttaactgagttctcaactggagacagcactgacttccccatttccctttgcgggtaggtggcattccagattatgtggtggtaagcttttcttttgcggggagagaagacagggcagtactcctgatacctaataactatagagcagacatgttaaacaccctgtaattatcaggccacttccccaactgcagaattgcccatctcacgtgcacacacaggacccatgttgagaaaaatgaagaaactgatgccttattctttaaagtagttataagttgaagatgtagacctatcttggcattctaaaattctgtaacaacccttctgaaatgggtgtaataaaatgtcaacaggttaattggttcgtgatcactgtggcttaaaaatctagttaaaatgctaagacttgtgcacagtataggcaaagtcacttagattgtttcaaaaagtatgccttatagaaataaacatttgacatacataaataacccttggtttacacataactcgcatttgagaaatgaatgtgttgtagatcatttagaatctttttcaatcaaaaattgaaagaaatatttcgtcacccaggtcaaccagagattgctggttttactcatgatacttaagtagagtatgatagttactatttcaccttcagctgtacttaagatgttttcctggaaaaattcattctgctttctgaccaggatttccagaaactctgacccttctaagaggtctgggtggaattgtgatggtgattctgctagtagacagtgtaacttctgcgtctacaaaaagaggataggccgtcactgctcacatggctttgcgtgaaagcccaatggtactgtctctatggcagagatgaggaaggaacaccagcgtcctccaactttcctgttcttcctttgggttaatggccactgtaaggaaacagttttctgccacgtgtggggtgatttgaatgtaaaatgcccaactctcatagcaggctgaacagaaacattttttatactcattgttaatttgttctaatctaaattacttttagactattaaatattattctattttaaagttaagggactaatgcctctgataacctgattaaaaaaaaaaactttctgatactcagaagttaagatttattcagttgaagatcatttctttcaggtgttgatcgtgtgatatttttcacatctgtaatctgaggttcatatgaaatgatagtgaaataaaattgttcatttaggtctttttgtcatgttaatatgttatcaggttaatgggaagtttaatctagttaatgtaaaattaataaattgtaatctagtttattgcttttttggaaaagaatactgaaaacattgtttacttaatacacatgacctgaggtaataaagaggagctggcctttttgaggggggaataatggcagtgaataatattatctaagacagttttgccagctttaaattcctggaagttcatccaagaagtcctgatccctgtgttcagtaaaatcatgtgagatcaaaatataattctgattttagatctgacaaattctgtatctctgttacaataggtacgacaacaattccacgatgccaaattcatggcagacattgatctggatccaggctgtacattgaataaaaagattcgaaatgcacagttagcacagtataacttcattttaggtaagaatggaaacttaccaaagaaaatttgccacacctcaggaaaatctactgaaaccttgagacaggtttaagtgaattgtaatcaagaatttatttagttccttccagtcctgattttttttctattatatattttaatatataataactataaaaataggctcatgcatacatactgggtttttttttttttcacttaaatcatggatgtctgtgagaaaatattttgctattataacaagaatgaagacgcattgcttttaaacacatctattggattactttctcaagataatgccttatgtgggattacttgaaaaaagatattcatgatgtttggggttttattatttggttgttacgttgtctagattgactccataagcacagtagttttagatattgcaaagagtttcttttaaatatcaacacatggtcacttgtaccttttaatgtatcagaagctatggggtaggttttgggtcctaggatcatttcttttcagatgttcagtgtgaattcttccatatctttagattaagtctgacaaagctttgtgtgtttgttttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataa

SEQ ID NO: 2224 - DNA, 1021 bp, Homo sapiens
tctatgaactcaattccaaaaataatttacacctggatgaatctttttggaaaattttaccaaacagcatcatcttcagtgcttttctaaaccaaggatagaaaaatgcataaaccattggattaaatgtagagttcaagtagccaaaccaaatcaatacatcattcaaagtaggtggaataatgtagtgaagaaaagggtccatgactgtacagataaagaaagggcaccagcatattaggaaaactcccatcacaatccccaatgtcttcacagctttcctttctttgctttgtgaaattccatttttcatttccaatccaatttggagcttctgattggcatcactaattaatcttgcctgttctttagcgataagatatattctgtaatagacacataacataatagatccaggtatataaaaagaagtcataaaggtcagtaccccagatattttgctaaagaagacagagcaacctcctctgcagtgaacatgtttgtaatatatctcttcagcgcctttgaagtttagctccagaaagatcattccaaatgcaaaaacagcagggacactccaactaatgaagatcatcacacaaataaccaagatattcatcttggctttatatctcagtggatcacacacagcatagtagcggtcaatggagatgaaagacaaatggaaaatggaggctgagctcagcataatgtcggtgcttgtgtgaattttacagaagacttctccaaaataccaacagtgctcagcagatctcaccatactgtaaggcatgaccagacaccccagaagaaagtccacagtggccatggaatgaatgagccaatttgttggggtatgaagttgtttgaagtgtgatatagaaacaataactatcagattgccaacgagtgtggtcagaattatgagcaccattaaactgtacagggaagcacggacatcatttgaccagttgtttttcacacaggaaatattaattatattgtggcaaaagggcatcat

SEQ ID NO: 2225 - DNA, 98099 bp, Homo sapiens
tgacgggagctctgctcaggcttcaacatggcgggccgtttcggttgacttcgcctgtggaaaccgaattccccctccatggtttccccaggatatgagttgggggcctcacctcgcctataagggtcaggcgagctttctggatgctcgagggacctttcggcctgcgcagccggagcagcttgtcccaatgccctgccatttctgtgagggcccacgaggcctggaggagcctcggagcccccgcaggccctcgcgtcactgcctcaagagggtgctcggagccctgctcgggagctggtccccaacgaggtgtggaaccccttcttgctggaactccacggagagactggtaataagatagtaataagaccgactactgtttattgaacctccgctagtcactggctgtcacgggttgggcgagaggtggaatataaggcccagagttcctctattatagccatggagagccattaatacctgcttaatagagttgtggtgagacatggaatgggcaagaaaggcactcgatttatttgatttttagaatcatgattattattattattttgagacggagtcttgatctgtcgcccaggctggagtgcagtggtgcgatctcggctcactacaagctctgcctcccgggttcaagcgattctcctgcgtcaccctcccgggtagctgggatgacaggcgcgcgccaccatgcctggctaatttttgcatttttggtagagacgggttttcatcatgttggccaggctggtctcgaactcctgatctccactaatccacccgccttggcctcccaaagtgttgggattataggtgtgagccacctcaccagaaagtgccaagaaaggcactttagacagtgccagagttgaggatttggcctctgactcgctgcagttgccacactgcagttgccacactgtggccttagaacagtcttatccagtcctgaaaaccccagtgccttggaaacatcaggattggtcagaaggacagtaagtccttaaggcgccagcccctgctcctccccccagattgaggggtaagtattccaagctctatgcaggaccctaatcctggatgtggacacccacagtcctgctaggacctgcttccagaagagttgatcccagccgtgaaagtgcatgatgccttcagcgaagcaggcaggaaaggctcaagtgatcctcctgtatcaccctggtgagtagccagtagctgggaccacaggcgcgcaccaccacgcctgcctaatttctttgtagagacggccttcgtcatgttgcccaggctgctctggaagtcctgagctcaagcgatgcgcctgccttggtcttccaaagtgctgggattacaggcgtgagccaccacgctcagcccaatttgtgatctttcatgcactctttcatgtagcatgttttcaaggttcatccaacttgcagtgtcttaatgctgaataatatttcattgtgtagatataatgtatttttcaagttttgtttatttttaattggtacacaacaaatatttgtacatatttgtgtggtacatatgtacatgtgatatgttgttacatgcatagaatatgtaaggatcaatcagggtatttaaggtatctgtcactttgagtatttgtcattgccatatgttgggaacatttcaagtcttctcttacagctattttgaaatatacaatacattgttgttcactgtagtcaccctactctgctatagaacattagaacttaactccttctatctaactgtattaaccaaccactcttccctgccaacccacacacccttcctagcctctggtatctatctgtccaccgtcaacttttttagctcctacgtatgtgataacatgcaatatttgtctctctgtgcctggcttacttcacgtaacaatgacttccagttccatccaggttgctgcaaacgacatgatttcattctttttttatggctgaatagtacttgattatatatatcgcattttctttatccatttgtctgttgatggacacttaggcagattctatatttttgcttgtgaatagtgctgcggtaaacatggaagtacaggtatcatccctttgatatactggtttttttcctttagataaacagccagtagtggcattgctggattgtatggtagctctattttcagtttcctgagaaatctccatactgttttccatagtgactgtactcatttacattcccacacataagagttcccctttctctgcatcctcgcccacatccattattattttgtctttttaatcatagccgttctcattgggtgaagatgatatctcattgtggttttaattttcatttcccttattattagtgacgtcgagcattttttcatatacctgtgtgtcttctttggagaaatatctatttatgtcctttgcccacattcgttcattcatttattggagtcagggttttgctctgttgtccaggatggagtgcagtggtgcaatcacgagtcactgcagcctccacttcctggtctcagatgattctcctgcttcagcctccagagtagctgagaccacaggcacgtcccactgtgcccagctaatttgtatgtgtgtgtgtgctttttgtttttgtttttgtatttgttttttttttggagacaggatgggagtgcagtggtgctatcactgctcattctagcctcaatctcctgggctcaagtgatcctcccacctcgttttttgatttttgtagagatgaggtctcactatgttgcccaggctgggcttgaactcttgggctcaagcaatcttactgcctcggcctccccaggtgctgggattacaggcatgagccaccaaacccagcctaatttttgtatgtttttgtagagacggggttttactatgttacccaaggtggtctcaaactcctgggctcaggcagtccacctgcatcagcctcccaaagtgttaggattacaggcatgagccatcatgcctgacccttttcccacttttaaatggaatgattattattttttactgttgaggtgtttgagtttctcgtgtattctagatattaattccttgttggatgaatagtttgcaaatattttctcccattcaacaggttgtctcttcactctgctgtttcctctgatgtgcagaagctttttagtttaatatagtccaatttgtctacttttgtttttgttgccgtgcttttgaagtctcagccataaaatcttttcctagtgtcctgaagtggttcccctaagttttcttctggtagttttatggttttggggcttatgcttaagtctttaatccatcttgagttgatttttgtgtatcgcgaaaggtaggaggttagttgtgttcttttgcatacatatggatatccaattttcctagtaccatttattgaagaggatgtcctttccccaatgagtgtccttgacacctttgttgaaaatcagttggctgtaaatgtatggatctatttctgagttttctattctgtttcattttatacctgtttttataccaatactatgccgttttggtcactagagccttgtaatatatgttgaagtcagatagtataatgtctccagctttctttttacttaggattgcttctctattcgagctcttttttggttccatatgaattttaggattattttttctacttctgtgaagaatgacactggtatgttgatagggattttattgcatctgtgtattgctgtgggttgtatggtcattttaacaatattgatttttttctgatccatgagcatgagttgtcgttccatttctttatgtccttctcaattgctttcatcaatgttctgtagttgtccttgtagaggtttttcacctacttcgttaaatttttttcctaggtattttattttcttgagctatgataaatgggatttccttcttgatttctttctcagctagtttattattggtgtgtagaaatgatactaatttttgtatgttgactttgtatcctccaactttttttttttttgaatggagtcttgctctgtagtccaggctggagtgcagtggtgccatcttggcccactgcagtgtccgcctcctgggttaaagccattctcctgtctcagtctcctgagtagctggaactacgggcgcacgcaaccaggcctggctaatttttgtgtttttagtagggatggggtttcaccgtattggtcaggctggtcttgaactcctgacctcgggtgattctcctgcctcggtctctgaaagtgctgggattacaggcatgagccaccgcacctggctgtatcctataactttactgaacttacttatcagatctaagagtttttggtggagtctttaggtttttctagatacaagatcatgtcatctacaaagagggacagttttacttcctcttttccaatttggatgtcttttatttgtttctattgtctgattgctctggctaagacttccagtactgtgttgaataggagtggcaaaaatagacatccttgtcttgttccagttcctagaggaaaagctgaaagccacgataggatggtgttaactgtgggtttgtcatatgtagcctttattatgtcgaggtattaataggctccttcaatgcctagtttgttgagagtttttatcatgaagatcttttgaattttatcaaaccctttttctacatctcttgaaatgatcatatggttttgttcttcattctgttgatgtggtgtgttatctttgttgattgatgtatgttgaactacatttgcatttctgggacaaatcccacctgatcctggtatgttatcttgttgatatgctgttggattcagttggttagtattttgttgaggatttttacatctatgtttatcagggatattagagtgtaactgtttttttttgttgcattcttatctggttttggtatcagggtactgctagcctagtagaatgaggaagaattccctccttttcaattttttggactagtttgaggagaactggtgttagtttgtctttgtaagtttggtagaatttggtagtgaagtcattagcagtgaagccattgggtcctgggcttttcactgtttggattcttttttattatggattcaatttcattactcatgattggtctcttcaggttttctatttattcctgattcaatcatggtaggttatatgtgtcaaggaatttatgcatttcctctaagttttctagtttattaatatatagttgttcataatactgtctgatgacttttggtatttctgtggtgtcagttgtaatgtctacttttattcgtttatttatttctttattttttgacacacggtctcactctgtcacccaggctggagtgcagtggtgtgatcatgactcactgcagcctcaagctcctgggccgacgagatcttcccaccccagacttctgagtagctgggactacaaacatatgccaccatgcccagctaatttttgtattttttttttagagacagagtttcgccatgttgcccaggtttgtctcatactcctgagctcaagcaatccacctgcctcagcctctcagaaatgctgggattacaggcattagccactgtgtctggtaatgtcttatttttcatcttggattttgtttatttggatcatctttttcattttcttgtttagtctaactagccgtttattgattttgcttacctttttgaaaaaggaactttttgtttcattgattctttatattgtttttgaaatctatttcatttagttctgctctgatctttattatgtctgtccttctactaatttgaggtttgctttgttcttgcttttctagttctttgaagttatcattagtttgtttatttgaaatctttctacttttaaaatataggtgtttattgctataaacttccctcctagcactgcttttgttgtatcccataggttttgttatgttgttttcaattttcacttgtttcaagacatttcattttttgagacagggtctctctctctatcactcaggctggaatgcagtggcgtgatcttggctcactggaacttccacctcctgggctcaagcaatccttctgcctgagccttctgagtagctgagattacaggcacacactagcatacctggctaacttttgtatttttttgtagagacagaatctcactatgttgcccaggccagtctcaaactcctgggctcaagcaatccacccaccttggcctcccaaagtactaggattacaggcatgagccaccacacccagcctgtttcaagacattttttgatttcctctttaatgtcttccttgagctaaaggtcattcaggagcatgttgtttaatttccacgtatttgtacagattccaaagtttctttgttattgatttcctatcctatgtcactgtggtctgagaagatactggtatgattttgatttttgaaaatttgttgagacttattctatgtcctaacatatggtctatcttggagaatgtttcatgtgctggtgaagaggtatgtgtattctgtaactgttgaatgaaatgttctataaatgtctgttagatccatttgttctaaagcacagtttaaaatcagtgtttctttgttaatttcctgtttagatgatctgtctaatgctgagtagagtgttgaagtcctcatctattattgcagtctatctctccctttagatctaatgacatttgctttatatatctgggtatcccagtattgagtgcatatatgtttagaactgttacatcctcttgctaatgtatctccatgtcattctgtagtgaccatctttgtctctttttactgttttgtttgtttgtttgtttttgagatggagtcttgctgtgttgcccacgctggagtgcagtggtgtggtctcggctcactgcaacctccgcctcctgggttcaagcgattttcctgcctcagcctcctgagtagctgggattacaggtgcctgccaccatgcccagctaattttttgtatttttggtagagatggggtttcaccatgttgaccaggctggtctcgaactcctggccttgtgatctacccgcctcagcctcccaaagtgttgggattacaggcgtgagccactgtgcctggcctctttttactgtttttgacttaaagtctgttttatctgatataagtatagctgctcctgatcacttttggtttccctttgcacagaatatctttttccagtcctttcctttcagtctgtgtgtctccacaggtgaggtgagtttcttgcagttggcatatatttgggtcatgtttattttttaaatccgttcagccagtctgtgtcttttcagtggaaagtttaatctatttacattgaagactatttttgatatgtgagggttattcctgtcattttattaattgatttctggttgctttatatgtcctttgtccctttctttctctcttattgttgatcattgtggattggtggttttctttagtgataacttttgaattgttcttcttatttatgtgcttgctctaccagtgggttttatactttcatgtgtttctgtgatggtagatatcatccttttgcttccagctgtaggactgccttacatgtttcttatatacctggttgagtggtgatggaaaaccaacggctaccattaaacttagtggtgaaagtcttaaagcttttctcctaagatgaggaacaagccaaggatgcctgctcttgctttttctattcaacattgtactggaggttctagccaggataattagacaaaaaaaccaaaacaaaaccaacaacaaaaaagaaaaagcatctagattggaatggaaaaagtgaaactgtattttttgcagataaataatgttgtatatagaaaatctaaggaacccacaacaacgataacaacaacaaacctgccggagcaacagttgagttcacaaaagatataagatcaatgtgcaaaaagttatatttagaaacactagcaatgagtagcctgaaaatgaaattaagaaagtaattttatttacaatagcattaaaaaataagactaaaacaaaagaaatgtaagactacaaaacattattgaaagtgattaagtaaagacctaaataaatagatacacattctgggtttattgaatggaagacattactgttaagatgacagtactccacaaattgatctacatattcaactcagttcctatcagaatcctagcttctattttgcagaaattgacttgctgatcctaaaattcatttgaaaatgcaagggactccgaagaagcaaaatgatcttgaagaagaacaatgaagttgcagagtccacactttattatttcaaaacttacttatagtggttaaaattgtgtagtactggaataaggatagacatgtagatcaatggaatagaattgagagtccagaagtaaattcatacatttaaggtcaattgattttccacaagggtatcaaggccattcagtggaaaagaacagtctcttcagcaagtggatgaagttagatctcttcctcacatcatacagaaaaatcaacctcaaatggaagaaatatctaaatgtaagatcccaaaccgtactcttagacaaaaacataggtgtaaatttttctgatactgacttagtaatgatttctttttttcctctccttttatgtgggacaggaaaactagaggggtttagagttgtcttactgcttttcccctatgtcagacaaggccctgataaagcagtttttctttagggcagggctttcacacagagaatagaatgctctgggcatatttcaaaatggttgctgtacccactcactctatccaccaactagggtatattttgaaatggttgcttttcccttttccttgcctaaagagcctgaggaaattttcttcagccttcatcatgagaaccagctagggtttctggaagtaacattcatgaaagtataaggggttcccaaggcgggacttcaacaagtttttaactctcaagctagtccacactcagccaccggtaattaattgactagcatttaagtgttcctaccaattactggctcctgtggcttctgctctcaggtaaactgtgatgttctgtagtcacgtgtctctctagtttttgaggaagtggtttgccctgtgacctctattctctgacagatctaagaaaagttgttgattttcagtttgattatcttttttcctgttgtgaagatgggagtgatgacttccaagttctctgcatgttggagtgggaactggaagacctaattaacttcttaagaaactgccaaactgttttccaaagtggatctagcactttacattcctggcattgtatgagagtttcagtttctctctatctttgtcaacacgccatctttctaattttagatattctaataggtatctagtggtttcttattgtagtttgaatctgcatttctctaatagctagttatgatggccctcttttcattggcttgtcagttgcaaatctttattagtgaagtatctgttcacatattttgcccattttttaaaagttgggttgttttcttacatttgaagtttattttttcttataatcaaaattttaatgtatacataacaaattgtacatatgaggtacagtgtgatgtttcagtacattttacatggtataatgatcaaatcatggtaattagcatatccattgccttaaacatttaccatttctttgctgtaagaacactcaaaatcctctcttctaactagaatatgggtgtattttaaatgtacacctatttattttctcacaatcctagaaaatgatagcttgagtcaatgaagtttcccctgcaagtcctatcaaccttgcttactttagtgaaatttaatatggtctagaaaacactgagccctctggttattctctctaacccacaaaggaagccgaacacttgataaaaagttcatcagcgtaaataagaagaatcccctccattacatacaaaagaaaaaataactggagagatcatctctgctctaaggtgattatcctgtggtctttggttttggtacgttctccccgaccccatgcccttttccctcatctttaatgagtatctgtatgtgtggcagaacagcgtgtttttaagtctctgcagtcttggaccaagctcgttttattccctactctacgagaatctcaagagcaccaggattctgtttggagttgccatggacacagagttcttaatccagtactggcttattctcaatacgaggtaaagacctagaggtgagggtctctgagcaaggtagtcccatcccatcctctgccctctctgttggctaatgttgtcctctcatcctcatcaggagaattaaaatcatgtaaagttttggtgggggaactaggtggtggtttctggggcccacagacaggaaagtttgcttatagccagttggggggaccactaattgatattcctttcccctcccagggaccttacggagtccccttatcctcagggtactgggggacaactagtgggtgtagggccaaatagtaataaccttgttatttgccaggaatggggtaaagatttgatctaacaagcttggttttgggaattaaaaaatgaaaaaaggaaaagctataatcctgaaaggcaacaggagagaaaagtgctaacaggatcttgaataaatttctccctcttagagaaagttgtactgaagacacgagacctgagacttgtgtcattttagcggctgaaccgaccccaacttcttctgagcggcagtggcgccagaagcagtctggctttcaggtaagcaggtccagggcttacagggagaaactcccaggtatccagctctgccttgggttgccctggttcacatccaaaggtgtgcttgggccacatctctggagcagaaggtggtagactgagagctttgatatttctatttctattgcacatgagctggtataaccccaaaggtatggaatttgctgctgtctgtgacccagcaaatagaaataggaaagtaatgaggtagaaaaataatagaaatagaaaaaaaattgtaaaaataaaataagcttcattctatgcctgttaatgtccttaaaaataggacatttttaggcagtgtgataacatgcatctactggttgctttcatatttcctataggggtggctgcttgccctaatggtggatgctctgttcaggatggtgacctagtgctcagctctggaagccactccacagagatggccaccgaaagggcttcagtggtcccatctcaacacctgaaacattgttaattattacagtgaaggccacaaatgggcttttattagtgagattggtgacttacaaagcagcatgatggttgttacaattatatgacattttaagatctgtgaatcagctaaagtgttttggagacagcccacccttgcataaacaggataaaggtttatgaatatggcctgtagtgtatacttagagatgacaccccaggcttgatcctcatatggtcctatctccaggaaggtttaggaagattttggcctctggaatattaggattctgttgagaatgaacctttcatgcttggagcacctaaagtacagaaagcttacagaagcttatgtaccgtgcctgcttgctactgaatgttttgttaaatgaatatctgtatgtgtggcagatttgattggagagctgcttttcattataacctggtagcctgattataaaggtgtagctaaccttcacctaactcaaacttctgtggtttctcctgtctaccaaaaagcatttaagaattctgcgtgatcacgttattttaggatagtttgccattctcaccttccttagaaggcaatttagctagctacttatgcatgtcccatgagggaagtcagtctgtgctcccaagcagcttatcaaagtatgatttcagacttcatgcaatactctccctgaaaggagttcaggtaacatgtatggatgtcttgtgtcctttttggagattagtttcccaaggaactcgcttagcagtcctggcttgtcacctggatctgaagagtaatttgagtgtcttcccattctcttcctcggtagaagatatctgaaaaatccagtaatcattcaataaggctgcttatgtcagaaactcaaattcttatgtttttggcgttttgaacattttcccctgttatgacttattagtgtattctgcatagacaacccagttgtccttcctgcagaaaagcagcagatacctctagatgcctttctttttgtaaaaggtattgtttttcctgagacctggatgaatttccatgagccattcaagggcatgagaacacccacttagaacttgagaggttcccttcatggccctcagactgggctaacgagatttgataatttgaactccagcactcctttcctcacaggctgaaagaatagcacagtattaatgtctatctgcgcttaaaggtttgagctatcgaccacagtccaaaattagtttgtgtaggagaacttttacttaaagacataaaaagataccgtttaatatattgcttctaaaatgtgtttctcacacatttccactgtgagaacgaggttctgtggtcaaataagtccagaaacctcagcatgctctagggaatcccagtttttatcagcagcagccaaaaaaaaaaaagcgtgcaatcagtttctgaaacttatttaaacatttgaaaagttagcaaattgtggcaaagagcattaattcttgagtcttgggagtgtattactttgataagcatgtttgtgtatttgaaactaaaactatgtatcagcttatattgccacatactgatttttatgacataatatatggtgtagagaacaggtggtctaaaaaccaatatttgcaaaatgctgaatattcagcatggttttatgaagttgacagatgtggagtgtattctgcatgtgtcttaacttacagatgaggaaatgaagttgtagagagattaaattagctaagccagtggtttgggtgctaggaagtcttgattttgtaaaatatagccatataatttaaaaaaaccgagaatccagacaaaaagaaaacaaaatcagggcaacagcgattttcagggaagaaaggagttaactataaggtctgactgcctgcggggccgggcagaacagagtcttatttctcttcttggagaaagcaagtaggagaagtatcactgagttcttttcccagcaaggaataaccctgggaaaggaatgcattcccagggagaggtctataaatggccgctctgggagtgtctgtcttacgcagttgaagataagggatgaaatactccctggtcttctgcagtgccctcaggcttgctaggattaggaaattccagcctggcgaattctagtcggacccattgtctgctctggaaccctgtttcctgttaagatgtttatcagtgacaatgggtgcccagtgggacatggaacctcatcagtaattctaatttcgccctggccttgtgatcttgctctgcctgtcttcccttgtgatcttttattggcctttcaagcatgtgatcttgtaacttactccctgttcctacccccctccccttttgaaatccctaataaaaacttgctggttttgcggctcaggaggcatcactgaacctgccaacatgtgatgtcagccctggaggcccagctgtaaaatttctctctttgtactctttctctttatttctcagactggctgacacttagggaaaatagacaagaatctatgttgacatattgggggctggttcccccgatgacaactaggatgggtgaaaactgaggaggtgattggaggtaatagagaatgaggtactcagatgaaattataagaaggggacttaatactaaagttgaactggaattaactgccctcgaaaaaggttgttacacattgaggtgaagttgcagttacttagtctggatgcatcgctatgttcacagcccaagatattcactgttggcacataaaacctcatttctaataagaaaaaatttcatcccagttcaatgagtgtatgcaaggaatcactcatagagttagtgtagctctttgattcaaagcattagaataatgtgtcctgtctgactctgatcatatttgtcccacagtccccatcctgttgacctggtggaagtcatcattgatagagacaccgatgacatgtgagttataaaggatgtacacacaaacatacacaaacaaaacagtgacagagaaagatattcagattagtgggatttgctctcaggagtgtccatggcaatacagagtgtcttggacacagttcatcttctcactgtagcacctatagttaaacatccacatttttacaattgttttggataaaagaggaacagagtatctggctgttactgtcttttcaccatttgttagtagcagccaaatgccttgaaaactcagattttctgtgtatgagacatactagagtgggccgagggaagagaaaatcctatttggagcaaggaagaggtaggagtacttgggtaactgtgaagtcctcagcagaaaggaacagagctaagagacttggaggtgttctccagcctccagaactctgccaccatggaggctggtgctccggaccttatatcaccaccatatcgggttgtgcccctgtgaaaaacctctagttacttgatgcgttttgtggggctggggagacgcccatgctgggtgaaagtaatgaggtaatggaggatttttgaagcaggacattcaatggattaagaggggtgactacctaaaaattggagttgagtttgaaataactgccaccacaaaggctgtcacacgttgggatgaggttgtaatgaaaaggttcacttaaatctggaagcattactattttctccatcctaagatggtggtagccatcatataaatcctgatttctgataaaaaatgatatttcaggtccacatagtgctgtacacatgaatagtcagaaattaaccagtttatgtttagagtaatgaaagctagtttttcccgaaaagtaaatttcgaattatgtcacctgtctgactgtattcttttatcatcctctagtccccacacaagtgaactgacaggaggaaccaaggaagcatgtatctacgaaaggtgagttataaatagataaataaagacacatgtatgcgtaagtgtgcatagaagtatatacacatgcacaggcatgtaaacaaatctgtccatccatctatacacacttctctcaacacacgtacacaaacaaacccatgcacacaattgaatcttaaaacaaggagacagatggacatttgtggaattttctctcaggagcctgcatggccatacagtgttttttaacagggtttccagttcttctcgttgtagcatttgtaggtaactttgcatccttttttgatggagttatataaagaggagcaagtcatagaaggttgcttcttcctgttagtgtattcatcacctttagttcttagtaagcagttttttaagggactcagagttcctgagttcgagagcctaccagagtggcccaggggaggcgagaatcctatttgcgacatggaggagatagcagcagacaaggagcagtggagccctgggcagaaaggaatggagctaatggaacatggacttgtccctcaccgtccagacctctgtcaacatgtgaggttggtgcccagacccaaccccaaacccaccagctcattggatgcagcccttctttaggcccacagctacttgcctgtgtctcatggacaggaaagactagcatgatgggtgaaaggaaggacatgatggatggttttcacaggcatattcagacttctactggaaataaatcataaaaaatgtaagttacagggaaaacctgatgcaagttaattatagtgtaatgctcaagaaaatttacaaaattaattagatgttacagaagctataaaaagattgtgtttgatcagtgactaatttttaaagaggttctttgtgctacgtattaccacttcttttgcaaggaaacatcaagattgtgaattctgtaattgctcattaagcagtagtacatcagttgaatatgtagtattgatttcttaagccagtaaataaaaattttctctattcattttatggtacagtggaggcatgggtgaattaaaatgtatttctaatatgtagataggtttaatttttatatagtcatttaattgtttaattaattggccattgaaaaatgagtctttgttaattgttggaatttacttactggacttacgtggtaggatttgcataccctcacccattacatatgtgtatagttgatattttatttttatggaaaaactacttttggtgcaaaaattgtttttgctactagtgtcaaaaaaagagaaaatcatgtggtgtttatatggctctgtacctttttactccatgagcactgccttcagtgaaatgacaataactcatgcagcatccttcaacaaaaagtgaggtctaaataaattaaaagctagatgtaaacatatatatgtaaatatacacatagacacacacacacaaaagcatacatgtacagaagagagattcagatttggcaagttcattgtctggagcatccataagaatacagagtgtcttagacactgttttctaaagtctaattactgtagtacctgcagttacctttctatcctttttggatctagttggataaaaaaggaacaggtcataagagcaatgcttcttattcctattgcattggtcactcttatttagcagtagccaaaaaccttaggaaaatatgagtgagccaagagaggagacagtcctatttttagcatggaggaggtagcagtgggcagggagctgaggagctcttaacagaaaagaacaaagctagtagaaccctgatctcttcctctattaccacatgaggttactgtcccaaaggcaaacccaccatcagattggatggagcccctgccttaggtctgcagttacttaaccgtatctgaggggcagaaaagacatccatgattggtgaagagttattggtatttgaacttgagaaggcagaaacttacaagtgcaagcaaggtgggtgtttacaaactgaagttgaacttatgtaaattttgccagaaatggtaacttggggattagggttaggagtaaagaaatgtatataaacttcactcattaagtttttttccacaggcctaagaatttcattgcaaacatctgaaacctcgtttctagagaaaagttaaataccaggtttcaaataaataactgattaagatgtcaatttttagggtaactaaattataaattgtagagtaattattactcatttgtgtcagaaaaatagtctaggaagacatgtggagtcttcctatattcatttttaatcatttagctattaccccattgaactaaaaagagtagtctgtggtagagtcatcaatatatggggagaaagaaaagagggagataatgagattggtaagattcactcacaaatgaagtaataaagaattgtacttaaattttgattcactaggctgtttgttaaggcccaaaagcttttttacattatgtaaggctttcttttagggaaaaaaaatgatatattaatactagattccaagtaattaattgacatatacgttttcagagttcaaccagtttataaatgcagtagaacaattgtacataacttcaaccagaaaagcaagtctctgaagtcgcttgatctggcatgtacctttttaatccttagcactggcccagataaaatgacatcagtagtctttcactactttgatatatctgctgtaactcacctttcaatggtggtgtcattgaagacaactgatgttattaatctgggtcattgctaaagaatatatctatacacacacacacacatacacacacacgtgaatatatgtatgtgtgtatatatatatataggtatatcctttatatatatatttagtatatatagatacctacatacatgtatgtgtgtatatgtatgaacatatctatatacatatatctatatgtgcatatatagatatatacatatctttatgtacatatatgtatctatatagatatattctatagcactgaccccaattaataacatcagtagtcttttatgtataatactttagcatatagacatgcatgtatatatatagatacgtatatgtagatatattgtttagcatatatgtatacatatacagtatatatgtacacgtgtgtgtgtatacatgtataccttatgttattgtgctttactttattgcccctcagatattacttttttataaactgaaggtttgtagcaaccttgcattgagcaagtctcttggtttcatttttccaacaacacatgctcactttgtgtctctgtgtcacattttggtaactcttgcaatatcttaaactctttttttgagacagactctcgctctgacacccaggctggaatgcagtggcacgatctcagctcactgcaacctcagcctcccgggttcaagcgattctctgccacagcctcctgagtagctgggattacaggcacctgccaccacgcccggctaatttttatattcttagtagagacggggtttcaccatgttcgtcaggctggtctgaaactcctgacctcgtgatccgcctgacttggcctcccacagtggtgggattacaggcgtgagccaccgcacccagcctattttaaacttttttgttgttatcctatctcttatgatctgtgatcagtgatcgttgacgttactattgtaattgtttgggggcaacatgaacatgaaccatgtcctataggacaactaccttaatcaatgccatgtgttttttgactgctccactgagtagccattccccatctctctccctcttcttgggcctccctacttcctaagacacaacaatattgaaagtaggccatttaataagtctatgagggtttctaagtgtcctagtgaaaggaagagtcagaagcctctcactttaaactaaaagctaaaaatgattgtgaggaaggctagacttcttgcaccagtcagacaagttgcgaatgcaaaatacgtgtatatattctcaaagaaaattaagactgctactccagtgaacatacaaatgatgaggaagcaaaacaggctgattgctaatatggagaaggttttagcggtctggatagaagatcaaagcagccatagcctttccttaagccaaagcctaatccaggacaaggccccctctctctgcaattcagtgatggctgagagaggtaagtaagttgcagaagaaaagcttgaagctaacaggttggttcatgaagtttaaggaaagaagccatctccataacataaaagtgcaaggtgaaacgcaagtgctgttatccagcagcagcaagttatccagaagatgtagctgagacaattgatgaaggtggccaagttatccagaagatgtagctgagacaattgataaaggtggccacacgaaacaacagattttcactgtagacaagatagccttttattggaagaagatgccatccaggacttttatatttggagagaagtcaatgcatggtttcaaagcttcaaagcacaggccaattctcttttaggggctaatgaagctggtgactttaagttgaggccaatgatcattgactgttctgaaaatcctagggcccttacgagttatgctaaatcaagcaagatgggtgactagagatgccttgtgctcatctcccctgcaagaaaacccaggaacaaatacacatctaaggtctgattagagtatcaaagggatagtcctggagtgcagcagaggagtggaggagacacacctgtggtgactggaagaccccacagcatggaagcactcagcctctgcagccccttctcccccacctgggttgaactggcccagagacaggaaggacttctcactgcagggtgaaggtaagcagaagatccccaccagccccactgccatcacaaacacagcgtcttaaggaaaatctcacagtatttgcaagccctgaggccagtatggagtactgccaggaatttacacagctgcatgtcctggactaggagtacaaggtgaaggcttcccacccccagagacctaagttgcagcaacacagcaccatcttgagaccagagtcatctcttgagtgtgccctcctctgggggccagtagccactgtgcgtctccagcactggagctttaccttcagtataccaagcccacatgggtgggttaaagccacaaccccagctgtgtggaggttggtcccagaattggcggtaactcaagtcctgaagagcagggagaaatcaacccccaccactacacttccagacagagaaataatctgcactcccatccagggtgaactcacccttgagctagccaaaccactacatgccttctctcaagtgggagcgtcccctaagcctctgagcagctgatataccccaaggtcaagagagtgactatgagtgcatgctcaggacctgagaaacagccctgcaggcctcatccaccacagacatgctcctgacctgcccagccgccctccgcctttaataaaggcctgagaaacagtcccacaggctgccgcgagcaggcacagcactgagtgggccttgaacctgtgtctcagacctgagaaacaagcagctgtgtgtgcctgagtctcagggctgagaaacaaccctgggagcttactctggccagcataccctcaggccaaataagcagccacatacctatgtcccagcttgaggaacagccctgtaggccaccccccgcagaaacactcccaggccaactaagcagctgtgcaacctttcatgagcccgagaaacattcctgtacccattcccagcggatgcacctccagaccagccaatcagccatgaatgcccatgtcctggacctgagaaagagccccatgggctactcccagaagacatgcccctaggccagccaagcagccttgtgcccacatcctgggtcatagaagcagccccctgggcttcccctggcaggcaccacccaggccagctgagcagcagtgtgcccacatcctgagctagaatagccctgtggactacccccagcagacccacatccaggacagctgagaaattatttgtatcccaggcctgagaaacaccccctcttggccagccctggcaaagatgccttcggtccagcttagtagccgtgcagctctatatttggcccatgagtttcccccagcagactggcctcgggccagatgaacagctgtgtatccacataccaggcatgggaaacagcccttcaggccactcctggagtgtgtgcttccaggccaggcaaacagctgtgtgcctgcatcctgggcttgagcaactgcatccccatgctcctggccagagtaacagcaccatggccagccccacaaagccatactccaagttttctgacccactgtatacctgcacacacccctaccctgagaaacagtccagagagcccacccctggcaaaggtgcaccaccattaccacaaacttccttagcctaggccactgagaaacttgcaaatgttactagtgtggatcacagcggaatgaactatatggagactacactttactgcatccatgtagaaccaaggccaatataccccaatgaactgacacccaagacccattcatacaagtaaattcatacaagtaacctactccataaaattggaaaaggtgactttttcaccagatgcatagaaatcagcatagaaacacatcaaccatgaaaatgcaagaaaacaggtcacctacaaagggaaataataattatgtagtaatggaccccaatcataaacatatgaaatgccagaaaaagaattcaaaagaataatcctaaggaaactcagtgagatataggtaatacagatagacaagtcaatgaaatcaggaaaacatgatttgaatgagaaattcagtaaagatagagatatcataaaaagaaccaaacaagccctaagagctaaacagttcaataaaagaaataaaaaatgaaatcaatgactttacagacaagaacaagcagaagaagtaatttctgaacttgaagagaagtcttttgaaataacacaggcagagaaaaaagaataaaaaataatgaaaaaagcctacaggatttattggacactgttaatttgaacaaatattcctattatgggcattccagaaggaaaagtgaagagaaatgtgaggaaaacatatttaataaagtgatagcataaaacttcccaactcaagagagagagatagacatctagttctaggaagatcaaagaaccccaaatacattcaacccagacacaaagacaaagattttttaagatagcaagagaaaagcatgaaaacgcttataatggaattcccgttagacgaacagctgatttcccggcagaaaccttaggctggaaaagaatgggatgatatatgcaaagttctgaaagaaaaaaaaaatctttcaaccaagaatattatacccagtgcagctatcttttacaaatgaaggagacataaaatctgtgacagataaacaaacaccaagataattcatcaccactagaccagccttacaagaaatgcccaaggcagtcttacttctggaagtaaaaagatgataaccaccatcataaaaacatgtaaaactttaaacgtcactggtagagtcaatacatagaaagagaaagggatgaaaccttatcactacagaaaactacccaactacaaaagtaaacagagaggcagaaaggaacaaaacatatacaaaccaaccagaaaacaataaaatgtcgcaaataactcctcacctaccaataacaactttgaatgttaatagattaaataccccaagaaggatatagacttgctgagtggattaaaaaataagacccaactgggtgcagtggctcacgcctgtaatcccagcactttgggaggccaaggcaggcagatccggaggtcaggagttcgagaccagccgggccaatatggtgaaaccccatctctactaaaaatacaaaaaatcagccgggtgtggtggtgggcacctgtagtcccaactactcgggagggtgaggtaagagaatggcatgaacccgggaggcagagcttgcagtgagctgagatcgtgccactgcactccagcctgggtaacagagcgagactctgtctcaaaaaataataataataaaaataagacccaactatattttatctaaaagaaactcaccttacctctaaagaaacacatagactgataatgaagggatggaaaaagatattccatgcaaatggaaaccaaaagtgagcaggaatagctatacttatatcagtcaaaacagactttaagttaaaaaccataaaaagtgacacacaagattattatgtaataataaagggttcagttcagcaagaaatagaacataattgtaatatgtgtataatataattgtaaatatgtatgcactcaacaccagagcacccagatatatatagcaaatattagtagatctaaagagggagctagaccccattacaataagagttgggcacttcattatcccactctcagcactggacaaatcatctagatggaaaatcaacagagaaacatcagacttaaactgcaccatagaccaaatggacataacaaacatttacagaacgtttcacctaacagctgtagaatatacattcttttcatcagcacatggaacattatccaagatagaccatatgttaggccacaaaacaagtctcaacacatttttaaaaactgaaattatatcaggtatcttatcttaccacaatggaataaaactagacatccataacaagaggaacattcaaaactatacagatatatggaaataaaacaacatgctcttgagtgacaaggagtgaagaaagaaattaagtatgaaatttaaaaattccttgaaacaactgtaactagaaacacaacctaccaaaacataagggacacagcaaaagcagtattaggaagcatgttcatagcaataaatggctggatcaaaaaactagaaaaatttccaataaaccacctaacaattctacctcaagaaactagtatggtaagaacaaactaaatcccaaattattaaaaggaactgaataataaagaccagacagaaataaacaaaattcaggcaaaatttacaaaaggttaacaacaaaaagcaggtttaaaaatatcaacaaaccattagctagactaattaagaaaaagagaagacccatataaataaaatcagaaagaaaaaatgggacctcacaacagatatgacagaaataaaaaggattattagagactattatgaacaactctacaataaatttgaaaacctagaggaagtggataaaatcctcgacccatacaactgccaagactaaaccaagaagaaatagaaaacctgaacagaccaaaaagaagtaatgagattgaatcaggaacaaaaaggccttcaacaaagtccaggatctgatgacttcaccacttaactccacctgcttttaaaaatgaactaatatcaattcttacactatttcaaaaaattaaagcagaggaaagtcttcctaactcattctatataagtaaactatggttgataaagtagtggtaggatttgagaggattcactccaattttgaaaacagttctactgtgggtaaaatgctatcaaatggcatcacatgttacagagaaatcacttgtgaaaggaagagtcatttgatatagtgaagttcgttgttgtcttattttaagaaattgcctcagccaccccaaccgttggcaaccacagctctgatgagtcagcagccatcaacatggaggcaacgccctccaccagcaaaaagtttatgacttgctaaaggctcaggtgatcattagcatttttttaaccaataaagtagttttactttaaggtatgtacataatttttttttgacataatgtcgttgcacacttaacagactacagtgtagtataaacataacgtttatatgcacagggaaaccaaaacatttgtgtgagtcacttaatgcagtttttgctttattgcagtggtctggaatgaaacccacaatgtctttgtgatatgtctatacacatttatgtattctataactatatacatattcttttaattacctttatatacatatatagaaagagacagagagagaaaagaagagaaaaatatgcaaaattcagcgttgggagtatctgtgagaatagtttctggttaatgactgtaattttctttcttaaatgtcaggtcttccagtgagctaagtcatgtttactatatcctttagattcatggaattcttgttattcaaataaattcttcatcactgttttgtgtagcaaatatctaatgatatatttttgcatttttttggtggctaaagtgtgtcagaacgactttccaggtttgaagattatgaaaatgctgaatatgtcgcttcatatgagtaagtcagtttgaagtttgaaaggagggagccattgatggatctcttttctttagttgaacagggcttacgctgaggcacaaaggaaaaagggaaactacggaaggatatcaaaatgtatgggtgtgtgggtgggagagtacaccatatttcctccaattgaattcttagacaagtattattttgaaaaaaaattccatccattcaggaataaatgttcttctagcttgaaaatgtaaaaagtatccttagaagaaattaacttcattagaagttttttttttttaaaagaaaacaggaatgcagaatgttacttactcatcaatagtgaacctttctcatttttactggatattgtgcgattcccagttttgtagatttcacctatgagcaagtggtattgatagcaaaagcaaacatgttttgctgactaaagacctctttatgctcactgggattttgttattatttgtttctaatctcactagagtactgagtactcctattgcactgacctgaaggcattttaccatgtactcactgtaacgaaacaacacattcttaaactggcttgtgtctgaactgcagacatattcaggagatttttcttctgcttctttcttgcccagttgtataaccattcaccagcttatgtcaatgttggagaggaagtgctgccatagaggaagttaactcatcatggttataagctgttggtgtctaaacaaagattacatgggaaacagagggcaaatacaaatagttcttcaaattaccctgagttttcattttctagaaatttttatcatgggccatcagtgaagaattcacggcaccacttaattaaactgtgtgtctgcatactagctatacattttctgtaatggagctgcccagggttgaggcaaaattagacagattgagcaaggcaagcatttcctttttctttcccctctccaaacaaaagaaagcaggtttttgttttgttttatttttaagttacaaagtctcattgcataaatataggaggaattggtagtggtccctgtgagaaacactggtgtttcataccagggggatgatcttggatttatagtaaaagctggaatcagtgcttggctttgacatcatgtattcattcatctgatactcaggaagtcattgaacctcttttagttttagattattcaaatgtaaactggttataatgctatctatgtagtggatattgtattgtaaaaaattagtaataaaactaaaataacatgcaaaaacactttgaaaactctgtagctctgtgaataggttttgtgcgaaaaactgaaaataacgtgagagtttattaaaggaaaatcagaaaatccaatcaacaaatctgcccacatgtagtcattcttaaactttgatacatgcacttctgagttctttaagcatatgcattttttgtttacagatacgagaccatacttatattattttgtaaataaccttattacttaatgacatcatgtctatattttcttgttaatgtatattcatgtgcacttacaacattatttgtaatagttttgtaatactgcatggtgtagatgtgctataattcatttaatagtcagatattgctgaacaattaagttttttacaagtttttactgttacaaaaaatatttgaggctaaatctttgcatatcgttggttatttgcttattataaattctcagaagtggaaatcctgtgtcaaagggaatgattatgatgctattggtattgataagtgcttgaacatcaagatgctaaagtgtacatttctcccctcccatacttaacgctagctgtcattgatttctttgatattagtaaatctatttgttctaatgcacattctttgacataccttcatttatgcttttttcagttaatatttcatcatttccaaactacctttggccagttaaaattggggtgtttttctgtctttggactgaaaagttaaatctgttgatcctttttctattttatgtaatataagtagtttctcccagggtgtcttgcttttcactatataaaaatgttgaatcttcatataatcaaatgtacctatacttttctttgtgatttatgcctttaatgttattctcagaaagtccttctctaccccaagattttaaatatattcatcaagatttctgttttgagcttattttcttcatttaaataaaatcgctgccctgaatttactttgtcttaaggcataaagtgtagaaatttacttttctcctgtgtgactaatagttttcacagcatcaaaatatcatccccctgtattgtccttaccctgttttagtgatctagagtgagatcaggaagaccagagagtcagtacagtgttttcattgctttgcatcatggccatctccgtaccgccagagtctgtaccagagaaaaatgtgtccagtgggagagatagcacctgccctcgatacgaatcccatttcattaaaaatggtcttgttagtgtcatgtagcttccaccttctattgataaaaaataaagtcatggtcatagttaatatttgtgctttgaattccactttgatattaatattggaacttatagtattttaaggtttagtatctcatgtctttttctcttttctttttctctttttttttttctgagacggagtctcactctgtggccaggctggagtgcactggcatgatcttggctcactgcaacctccacctcccaggttcaagccattcttctgactcagcctcccgagtggctgggactacaggtgtacatcaccacgcccagctaatttttgatatttttagtagagatggggggtcgcctaggatggactcgatctcttgacctcgtgatctgcccgcctcagcctcccaaagtgctgggattacaggtgtgagccaccacacccggcctctatctctttatttttaaactgtcatttaaatttagtttttgtctcttgtgtatagcatgtaatgcctttgattttaaagttatctgagtgtatttctcatggaatatgggaggaatatgtttgtatttatgatttctggtatgtttggctttattgtctttttctttatgaaaaatactttgatattttctttttaaattagtctatattttgctagtaattgatttgtttttatcccttacattttttactgataggcaagtcagaagcccatttctagtccatcagtttatatttaaatatttagaaaacataattataccatttttctccatcaatatcgagaataaaactggacttgtatctgtagaagataagaaatgcaatctgcctttacttctatcttcttccaaaccttgaatcctagtgtaagaatgcctaaaatttaaatcaatactattattgataattttatattatctttacttttagaatcgtttatttacattttcacctacatttttatgctacattaacagttgttatttagacttacttctgagtttatattatttaccatcttttctctataagtcatgttccttattgctctgttcttcattttgattcattgctcagctgactcaagcactttgagtaattatttttaggaaaggcacatagaggctatgctttgagttgctgcatgttggagtgtctgtctgttgctctcaaatgtgaacagtacttttcctggatatggatatattgagtcatagttatttccctgcaaactctgcatgtaactgcttgaagctgcatttacatagtacacttttttaaccaaaataagtctcaattgtatatttacttggtacagtttcaggggacactgaaacagattgaaggggctaaagccacccaagccactccttcatgccttcatgatctatcaggcttggttctgtatggtgatattgtcaagtgaattcagattgatgacatttccttgatacccagagatccagtagactgtgtgggatcagaggttcttgtaaaaagagaatggcaacttccggagagaattcgcctcttttggccaactgatcctctgtctacatcagccttaactttctaagcctgggtagaggtggtgggtccaggtggatgaggggaagattagaaggattggggatttcctttatctcaggttaacctaacatcattcatcaaaggccaattttgctttttttaacttttattttaggtttcgaggtacacgtgaaggtttgttacataggtaaacatgtgtcagggtggtttgttttacatattatttcatcacccaggtattaagctcagtacccaaatagtgatcctttttgcttgtctctctcctcctactctccccgctttggtagaccccagtgtttgcttccctctttgtgtttttacatccttatcacttagctataccacttacagatgagaacattcagtatttgatttttgctttctgcactagtttgctaaggataatagcctccagctccatccacgttcccacaaaagacaggatctcattctttttttctttttttgagacggagtctctctctgctgcccaggctggagtgcagtggcacagtctcggttcactgcaagttcttcctcctgggttcacgccattcttcctgcctcagcctcccgaatagctgggactacaggtgcctgccaccacgcccagctaatttttttgtatttttagtagagacgagatttcatcgtgttagctggggtggtcttgatctcctgacctcatgatctgcccgcctcagcctccgaaagtgctgggattacaggcgtgagccaccgtgcacggccgatctcattcttttttatggctgcatagtattccatggtgtatatgtaccacattttctttatccaatctgtcattgatgggtatttgtgttgattccatgtctctgctattgtaaatagtgctgcagtgaacattcacatgcatatgctttacagtggaatgatttatattcctctgggtatatactaggtaatgggattgctcagtcaaatagtagttctacttttagctcttcgaggtgtcgccatactgctttttacaatggttgaactaattcacactcccatcaacagtgtataagtgttcccttttctctgcaaccttgccagcacctgttattttttgacactttaataatagccattctgactattgtctggtgtgaaatggcatctcattgtggttttgattggcatttctctaatctgtgatattgagcttttttttgtatgcttctttgccacatgtatgtcttcttttgagaaatgtctgttcatgtcgaaggccaattttggcagtgccccagttctcctcagtgtctgtcctctttttttctccagtcttaggcacaggctgtgagcattgtcttaggattcatgcctcttggggtgaaatttgagtcctgtgttggaggcttcagtatgacagaaacttcctgaaggcttcagtaagacaaaaaattgttcctcatcagctaccttgtcttcagccataaggtaaaatgaggcattactgggggctccatcaaacaggttctcctttcttggattaatggaaggagcccagtctttcaggtgtttctcctttgaagtgtatcttactaaaatgtcttaccgctgcagttcctatgccacctcaaaggcaactctcactaatgtgtatctgttcactaggtgtctagtttgaaagagatgacaagagcatcatttactccctatgcttatccctgaaataccttattttattgctgttgaaactgagatctggccaaagtttgatgacttgcccaggctggcattaaaatacagttctcttctacccctcttttcttttttcatgctatattccttgagttgatgaccacaagtttaagcttagtattgccataaagttggagttggggctttgcatgcaatggaaatattactaaacatccaaagtttactgtcttattcacatatattctggataggaaagtaaaatactcatggagcagaaaagataaaattttaattattagtaaaaagcattttgttatacaacttctgaataattttcttttaaaattgtatttataaaggcctttgttttttggttaaatttataagttagaagaaatctgattgattttatttttgctttgtttttgcagcagcaagattaagaaaattgttcattcaattgtgtcatcctttgcagttgggtatgtgagacatagaaaacaccatgtattaaatatacgtgagacttaatgcataaaaaacaccacgtattaaatatatctgagacttggccaggtgtggtagctcacgcctgtaatcccagcactctgggaggccaaggcaggtggatcacctgaggtcaggagttcaagaccagcctggctaacacggtgaaaccccgtctctattaaaaataaaaaaattagccagacatgatggcgagtgcctgcaatgccagctgctcgggaggcctaggtggaagaatcgcttgaacctgggaggcggagattggagtgagctgagatcacactattgcactgcagcccaggtgacagagcgatatatatatatatatcactctttcaatgagaaagactgaaataaaaaacaaaaccaaaaagcatttcctgtccatcggtttctaagtagccatgtgccccatctaatgtaatctaatttatcatggaaatttggtttaagctggactttaagacttgcaaagaaacggcttttgtataagattaatagtaacatattaatattatttttcttccatctgcacaagtaaagttaatgaaaatcgaatgttaaaattctataattataagtaaagtgttttattaagtaccttatacatctagaattactctttaattctggaaacaatttacttagactcttctctacgtaagagtaagatttcatactatgatatagatttacgcaatatgatatagatttatgcaatataattgtttccttttgaattaatgatattttaacttgagctgcaactttttgaaaagtactttgaagatgaattcatcttcatagattaagcaaatagtataatcaatttatggggaatgtatttagaatatgtaacagcaagtttcaggaggtaccttagagttcaatactataaatatttatggaattgaattctttctcatgtacccatcactgtactagaatcgcccataaatatgtaatcatgtacttgctgaaaatgtcactgacaaaaaaaatcttggtcttttaagagcttatgttactcatgctttcatttggtttttattaataaattcttaagaattatccagattaataagattttattttttatgagaaatgggtgtaaacttcttatgaaattctcaaattttaagaagagtttacaaacagacacaggcaattttagttcagtttcacttttctctcttgaggtgttagtctgatggatctgctataaaagggcatgataacgtcttgtgaagtggtttggtgggaattttatttattaagaactgcttctattgggtgaaaacagtgatttttctgagattctatgacattacagtttttcctgccactgggcagtttaatactaaataataacattttggtacctgattattggcctaaatatagtataactatagggacaaaagcccctttatctttgctgttacttacttatttattcatttatttatttgttgtagaatatttggagttttcctgatcttgttggatgtggctctgatctttgctgacctaattttcactgatagcaaagtttatattcctttggagtatcgttctatttctctagctattgctttattttttctcatggatgttcttcttcgagtatttgtagaagggtaagtttgattatttttataatgcataaagctattttgtacttttctaagaagcactttgggaggctgaggcaggtggatcacgaggtcaggagttcaagaccagcctggccaagatggtgaaaccctgtctctactaaaaatacaaaaattagctgggcatggtggcggaagcctgtaatgccagctactcgggaggctgaggcaggagaattgtttgaacccaggaggcagaggttgcagtgagccgagattgtgccattgcacttcagcctgggtgacagggtgagactccgtcccaaaaaaaaagaggcatattagaataattaacaggagcattcaactcaagctgacttaaaagcctttgggccttaggagaaccttggtggtagtctggcagtaccccccagggtctgtgtttgagtgaggtggccatggattgatgctcctctgcttttggagaggggttgaaagagtagggaggattgcatcttgtggtttgagtgacagctcaaccagcacagccatagcacataaaacaccagggagaattataagtttctgatctaggccctgattcccagcacctttggacccacccggagcctgggagaacttgccatcgtgaagggaaggacacaggcctgactgtttttaccatgtgatgatcgtagagccccagggccttcagcaaacttatgcaatagctagggagtggttacagcaggttttgggcaagacccagtgctgtgctggcttcacgtctgacccaatgcagtcatagtagcggtggccacaggggtgtttgtgtcacggtggctcagaacagagagagagactctgtttgtttgggagaaattaagggaagagaacaagactctctttttggtaacccagagaattatcctgcatgttgtccaagaccattaaggcagtaccactatgagtctgcaggaaccacagagtttaggaggcttggggtgcctcctaaagcagataaaacttagatcacaatatccaagttctttccaatatctggaaagccttcccgagaaagataggtacaaacaagccctgacagggaaaactacaataaatacctaattcttcaatgcctagacaccaaagaacatctgctagcatcaacactgtccgagaaaacatgacctcaccaaatgaactcaataagacaccagaggccaatcctggggaaacagagatacgtgacctttcagacaaatcaaaatagctgtgttgaggaaacacaaagaaatttaagataacacagataaaaaaatcataattctattagataagtttaacaaagagattgaaataattaaaaagaatcaagcagaaattctggagccaaaaaatgtaattggcatactgaagaatgtattagagtcttttaatagcagaattgatcaagcagaagaaagaattaatgagcttgaaggcaggctatttcaaaatacatagaggagacaaaggaaagaattagaaacaatgaagcatgcctacatgatctagaaaatagcatcaaaagggcaaatctaagcgatactggccttaaagaggaggtgcagagagagaggggttagaaagtttattcaaagggatagtaacagaacttcccaaacctatagaaagatatcaatatccaagtgcaagaaggttacaaaacaccaagcagatttaactcaaagaagactacctcaaggcatttaagaatcacactcccaaagatcaaggataaaggatcttaaaagcagcaagagaaaagaaaccaataatatacaatggagttacaatacagctggcaacagactttttaatagaaatgtttcaggccaggagagagtgatatgacatattgaaaatgctgaaggaaacaaaacatttaccctagaacaatatattcagtgaaaatatccttcaaagtgaaggagaaagaaagatttttccacacaaacaaaagctgagggatttcatcaacaccagacctgtcctagaagaaatgctaaagggagtacttcaatcagaaagacaaggacattagtgagcaataagtaactacctgaaggtataaacctcactggtaatagtaaatacacagaaaaatacagaatgttatgacactgtaactatggtgtataaactactgttattgtaagtagagagacaactatgagccaatcaaaaacattgactataacaacttttcaagacataaatggtataataagatataaatagaaataacagatagttaaaaagtagtgagactaagttgtagattttgtattagttttcttattgtttgtttatgcaaactgttagtttataagcttaaaaataatgggttataagatagtgtttgcaagcctcatggtaacctcaaaccaaaaaaaatacaagggatacacaaaaaataagaaacatgaaactaaattatatcaccagagaaaattaccttcattaatggaagacaggaaggaaagaaggaagagaagactacaaaacaaccagaaaacaattgacaaaatggcaggagtaagtccttgcttatcaatgataacattgaatgtcatcagactaaacttttcaatcaaaagacagaatggctgaatggatgaaaaaacaagacccggctgggcacggtggctcacacctgtaatcccagtactttggggagctgaggcgggtggatcacagggtcaagagatggagacaatcctggccaacatggtgaaaccccgtctctactaaaaatagaaaaattaggtgggcgtagtggtgcacacctgtagccccagctactcaggaggctgaggcaggaaaatctcttgatcccaggaggcggaggttgcagtgagccgagatcatgccactgcactccagcctggtaacagagtgagactccacctcaaaaaaataaaaataaaaacaaaacaaaacaaaaaacaaaagacccattgatctgttgcctacaagaaacactcttctcccattagtctgaaaataaaggaatggaaaaatatattccattccagtagaaaccaaaaaagagcaggagtcgctatccttgtatcagataaaatagattgcaagacaaaaacgataagaagagacaaagaatgtcactatatcatgataaagggatcagttcagcaagaggctataacaattttaagtatatattcatccaacatatatagccaatatatatactgagacccaatggcttccctgctgaattttaccaaacatttaaagaagaacgaataccactcctgctttaactgttccaaaaagcagaagatgaaggaatacttccaaactcattccacaaggccagtattaccctgatatcaaaagcagacaaagatgcgtcaaaaaaagaaacaggctgggagcagtggctcccacctgtaatcgcagcactttgggaggctgaggcaggtggattacctgaagtcaggagttcaagagcagcctggccaatatggtgaaaccctgtctctactaaaaatagaaaaattagctgggcatggtagcaggtgcctgtcatcccacctactctggaggctggggcatgagaatcacttgaacctgggaatgaaagttgcagtgagcctagatcatgccactgcactccagcctgggtgacagagtgagactctgtctcaaaaaaaaaaaaaaaaaaagacaacaggccaatatatctgatgaatattgatgcaaaaatcctcaacaagatactagaaaactgaatgtaacaatacattggaaggatcattcatcatgacaaatgggatttatccctgggatgcaaggatggttcaaaatatgcaaatcaaccaaagtgatacatcatatcaacacaataaaggataaaagctgtaagatcatttcagttaatgctgaaaaagtgctggataaaattcaacgtttcttcatgataaacactctaaaaaaactgggtaaagaagtaacacacctcaatataataaaaaccatatatgacagatccccagtcagtatcatactgagtggggaaaaatggaaaagctttcctctgagatctagaacacaagtaggatgcccactttcaccagtgttattcaacatagtacaggaagtcctagctagagcaatcacagaagataaagaaataaagggaataaaaacaaatccaaattgggaaggaagaagtaaaattatccttgtgtttgcagatgatatattttatttggaaaaaactaaagagtccacaaaaaaatattagaattgataaattcagtaaagttgcaggatacgaaatcaacatacaaaaatcagtagtatttttatatgccaacagtggaccatctgaaaaagagttttaaaaagtgatcctatttacaatagccagaaataaaattaaaaatctaagaggtaaccaaagaagtgaaagatctttataatgaaaacgataaaacactgatgaaagaaattgaaaaggacaccacaaaatggaaagagattccatgttcatggattggaagaatcaatgctgttcaaaagaccatactatccaaagcaatttacagattcaatgcactccctatcaaaatagcaatgacattcttcacagaaatagaaaaaaaatcctaaaatttatatggagccataaaacacccagaatagcagctattctaagcacaaagaacaaagctggaggaatcacattacctgactttaaattatactacagaactatagtaaccaaaacagcatggcccttgcataaacagacacgtagaccaatggaaaagcatagagaacccagaaacaaatccacacgcctacagagaactcattttcaacaaatttgccaagaacatacattgaggaaaaggcagtcccttcaacaaatggttctgggaaaactggatatccacatgcagaaaaatgcagctagacccctacctctcaccttatataaaaatccaatcaaaatggattacatacttaaagataagacctcaaactataacaagaaaacattgggaagaatcttcaggacattggtctgagcaaaaatttcttgagcaataccctacaagtacaggtaaccaaagcaaaaatggacagatgggatcacatgaagttacaaaggttcttcaaagcaaaggaaacaattaacaaagtgaagagacagcccacagaatgggagaaaatatttgcaaaatacccatctgacaagggataaataaccagaatatataaggagctccaacaactctataggaaaaaaatctaatactatgatttttttaaatgagcataagatttgaatagacatttctcaaaaggaaacatacagatggtaaacaggcatgtgaagaggtgcttaacattgatcattagagaaaactacagtgagatatcatctcatcccagctaacatggcttatatccaaaagtcaggcaataacaaatgctggcaaacatgtggagataagagaaccctcatacactgttcgtgggactgtaaattagtagaaccgctatggggaacagtttggaggttcctcaaaaaatctaaaagccaccatatgatccagaaatcccactgctgggtatgtacccacaagaaaggaaatcagtagatagaggagatacctgcattcccatgtttgttgcagcactgttcatgagagccaaggtttggaagcaacctgtgttcatcaacagatgaatggataaagaaaatatagtacatatacacaagagagtattatttagctataaaaatgaatgagatcctgccttttgcaacaacatggatggaactggagatcactatgttaactgaaataagccaggcacggaaagacaaacaccacatgttctcacttatttgtgggctctaaaagggttaacagttgaactcatagacatgagtagaaggatggtcatcagaggctgggaatggtagtaggaggttgggggtggggaggtggggatggttaataggtacaaaaaaatagaaaaaaatgaataacacctactatttgctagcacaacagggtgactatagtcaataacaattgtacattttaaaatgactgaaagtgtaattggattgtttgtaacacaatgataaatgcttgaggggatagatacctcatcatctatgataagggtggttaatatgcatttaattatatgtcttgctatacttaaattgccatattggtgttttagtcatatatatgtgtcaaatgatgaatataaatttattgtttgaaaacttcccatgaatgtcatatttttcccttagtctactctagaaaatgcattttaaataatgtatgaaagtagaattcttaatggggatcagtcaatagttgtggtctttaaatatttctatctcttcttgcagggagatgaactcatatttttctgttttatattacaggagacagcattatttttctgatttacttaacattttagatactgccgttactgtgattattctgctggttgatgtcgtttacattttttttgacgttaagtttcttaaggatattcccaggtatgaaatataagactcacttctcttaaaatttttcatttactttttgcattttctgtggcttttattctgtataatcttttcaacttcaaatggctcattttataccaaatatgttgctttaaaatgaaatgtttaggtaaattcccacataggttgaaactaaaagattgtgatatttagggaccagtgaagagtatacacaccaagtaccattcattgaataaaaaagatggagtagccaaagaaggactttacttgtactaactttaacttcactacattttgaagttctcgtcaaattcccatttgtatcatttttggccttttggctaagatcaagtgtgacattcttattagtttcatatgtgatacataaaaaaatttgatattaaaaacaattcccctctgtgcttcaactacagatcccttacacataatgttctgtctgggtttttcccacagccaagagggaatttatttgagcatatgcaaaatttgagtgactttaatcacgattttctttctttttttttttttctagtttggtctttttttttaaatttttttttattatactttaagttttagcgtacatgtgcacattgtgcaggttagttacatatgtatacatgcgccatgctggtgcgctgcacccactaactcgtcatctagcattaggtatatctcccagtgctatccctccccccttcccccaccccaccacagtccccagagtgtgatattccccttcctgtgtccatgaatcacgattttcttttccttttttttttttttcttttgagatggagtctcactgtgttgcccaggctggagttcagtggcatgatctcgggctcactgcaacttctgccccaccggttaaagcgattctcctgcctcggccccccgagtagctgggattacaggcatgcacccccatacctggctaatttttgtatttttagtagagacgagtttcaccatgttggtcaggctggtctctaactcctgacctcaagtgatctgcccacctcggcctcccaaagtactggtattacaagcatgagccaccatgcccagcctcaatcatgatgttctaagaaatagaaaacagaacagaaaactaggagatgacacgtatagcaacacaacagtagagttttgcagtatagttgtggcagaaacaaagaaagctaaggcaaagttagaactgttagggattaggaaactaaagggtgtatgaggacctggtgactctctttttgttcttcttttctactgtgacaatgaggaaaatggaagagcaaacgtatactgggatggagatgtttgtggcttcctaagcttgttcatgggtcaaataccgggtttctttctgtaccctagcttccctggactacaactcaggcaccaactaagcatgttaagtgataggcttttggagttgtttgaaaatcacctcagccaatgtggtcctctgactagaaacctcagcatcacttgagagcttgctagaaatacaagaaaaataccttaggccccaccctggacccactgaatcaatatctctgggatccaacaatctgtagcttaacacgcttttccagatgactcttctttagtccagaccatcagttatctgctttgatgtttctgacggtaggagagataccagctagcacacttgggaagtatctcaatctgttgcctgcctaatgtgcatttgcagctgtagtgaacctctgttacagatgggagtaacagaggtgaacaagaatcctcaatttgttttgatgtggaaaaattgaaaatgctagtctcaaatcccaaaattaaatttacaaattctaagactctattgtttcactatttctctagaccagaatttttcaacctcagcattactaacattttgggccagatcattattgtcataggagggtggtgagcagttatattcattgcaggatgtttagcagaattcctggcttctatccattagatggaagtagcgcatgcatgcgcgcacacacaggcacaccagttgtgaaaaccaaaaatgcctcaagacactgccaaatatcccccatgtaggtgattgaggagaggagggaaaattgtccctggttaacaactgctgctctaaacttaatttatattcataaaattgtctgtttctgaagcaaaaattgatcttttaagtttatttttagatggacacgtttatttcgacttctacgacttatcattctgataagagtttttcgtctggctcatctaaaaagacaacttggaaagctgataagaaggctggtaagtgggcaaaacatgcttacgattcagaaaaatattttgtgttttgggacccattggcaagggttgatatctatactgtataatgttctttatttttatgttgatttatgtttcaccaactaataatggttttaaactctcaggtttcaggaaacaaaaggtgatacgaaagggatggatttgacctagacctcacttatattacaggtttgtgacacttaactgttgatttacttacattaacttcactttttcttgtaattatatttttattttgtttttgcctcatctaagccacattcattcaaagtattctttattcgtgaggctatatgctatgccattgtgatagtgtgacatatttgtggtttagccctggcaaggaagatttccatgtcatctcaattcaggactactcggttgcagcacaaaaacttgaatggattttcagctgactccatttgagtttcagtttattaagttctagtagttatcctgaatcccaaggatcccagagagaccgcttctcttcctagaaccccagagaatgaggtcacagctttgtagatctcaggtgttctgagtcagagggctataaagcacgttgggagttcccaccatcactggtgcccagaactcttggattttctttggtatttaagataagaaataaattccaagaacagggggaacttcagactgaggccaacataagtacatggcatatggtttgaaccagtggagtgttaagaacaccatgccagcttaatggtcattatgttggataatttaatatgttatcttgattaccctgagtattagctcttttctgtcaaccttaatcttaaaaggtatttttctgtgaaaatggagtctgatcatataaaattaacttttgtatgttattttaaatctataataatgtttgtaatagtgatgattttgacttccagaacgtattgtcgctatgtcatttccatcttcgggaggccagtctttctatcggaatccaattaaggtaagggtgtttatcttaaaaatactaatttctcagtgaatgtagactgtgtagtcataagtttaatattgacccagaaatgtcaatgttctttccaaaaggtactctttcaagtaaaacaatcataatggattgataccagttataattgtaccagtggttacaaaccacccccaaacttactggcttataacagcaactatttatttggctcatgatactatggtttgtgaatttgagatgggcttaactgttcaattctgtgctcacagagaggattgcttctctcaactgagttcattcatgcatctgtgggcagctactgagtcatctgaggactggctagtctaaaatgacttggctgtcctcagctgacagagccactgcgtgctccatgcacccctcaaggcccatcccatctggcatccactgctgccaacagctccacccccttgaccagcagagctgccatatgctgcatgcacttctaagaccctgaggactggcctgcctggtgcccaccctgctggtggcgccaccccaccactagcaaagccactgcacctagcatgcatacctctagggccttggaacgaatccgactgatggctcccaccccaagaaaagccataccactgtctccacaaacactcaccatctaggccactgaggcactcagagacacctctaaatgctgattacagccaaagaagtcacatgaagactgtattaccgcacccacctagaaccaaagtcaaatcgccctactccataatgaacactaggagacaactattggaaaaaatatttctctatgaaagctccataacattggaagaggcacctgttccaccagatgtgcaaaaatcaattcagggccacaagaaacataaaaagcaaggaaacattacatccccaaagaaacacaataatcccccattaacagaccctaaattttaagagtatatcaaatggctaagaaggaatttgaaataaggatcttgaggaaactctgtgagatacaagagaatacagatagacaaatcaatgaaattagaaaaacaatttatcatcttatgagaaattcaacaaagatatagatgtcattaaaaaccaaacagagatcttggagctgaagaatttaaggaataaaataaaaaataatcaagagaccagatgcagtaggtcactcctgttatcccagcactttgggaggccaaggcaggtggatcacttgaggccaggagttcaagacaagagtgattaacatggcaaaatcccatatctaaaaaaacacaaaatttagtcaggtgtggtggtgcatgcctgcaatcccagctacttgggaggctgaggcacgagaatagcttgaacccaggaggtggaggttgcagtgagctgagatcatgccactgcactccaacctggttgacagggagggaccctgtctcaaaaaaaaactatatatatatatatatatatatatatatatgtaatcaagagctttaaaaacagacatgggagacatatgggtgaaatctcagaagctcaaaggttctcatatagaatcaactcaagatggtcttctctgaggtgcatgatagtcacactttcaaatgtcaaaaagagggaatattggtcaggtgcggtggctcacacctgtaatcccaggactttgggaggctgaggtgggtggatcacaaggccaggagttcaagaccagcctggccaacatgaagaaaccccatctctactaataatacaaaaaaaacttagctaggtgtggtggcgtgcacctgtagttctagctacttgggaggctgaatcacgagatatgcttaaacccaggaggtggaggttgcagtgagctgagggcacaccattgcacttcaacctgggtaacagagtgggagtgtctgaaaaaaaaaaaaaggaaatattaaaaacagcaagaaaaaaagcatcaaatcacatgtaagggaaactcctttaggttaacagtggattttccagtggaaactttacaggtcagtagacaatgggatgttacagtcaaagtactgaaaggaaaaaaatacaaaaaaactataaactaagaatgctatacccagcagagctatcctctagaaatgagggagaaataaaatatttcccagacaagcaaaacctgagggaattcatcaccagtagactggccttacaaggaatgcttaagggggattctacaaatgaaagcaagaggatggctaccatcatgaaaaacatcaaactataaaactcactggtagagcagatacataagaaagagagagaaatcaaactttatctctacagaaatccaccaaaccataaagattagaaaaaaaaaaaaacaaaggaagaaaagaacaaaggatatacaaaacaaccaaaaaaaaaaaaaaaagaataaaatgacaggataaatcctcatctattaatagtaaccttgaatgtaaacagatcaaattcccaattaaaagatacagagttggttgccaagataaacaaacaaacaaaaaacccaactacatactgcctataagaaactaacttcacttgtaaaggtacacgcagactgcaagtgaagggatagaaaaagatactccaggcaaacagaaaccaaaagtgggcaggagtagccatacttatatcagataaaacagactttaagtcaaactgcatgaggagacaaagacagatattttataatgatgaaaggatcaacttagcaataggatataataattgcagacatatatgtacccaacactagagcactcagataaacaaggcaaatattagatctaaagggaaagacagcctccagtctagtaacagttggggtctttaacaccccgtaacaccctactcgtagcactggacagatcatctagtcagaaaatcaacaaagaaatgtcagatttcagcttacagagaggaataagttttagtattctatagcactggagggtgactacagttaacaatttattgtatatttttaaaaagaaaggctcttgagtgttcccaccacaaagaatgataaatatttgaggtgatggacatgctgattatcctgatttgatcattgcacattgtacacaggtattgagatatcaccctctaccttataaatatgaacaactattatgtgtcagttcaaattgttttaaagaataaaaaaacagtttttttttaaatcaaagaaaagaaaataacatggcttggctgaatggtcccatgtggtctctcattctctagtaggctacttcaggcctgttcacatgatggcagtggcaagagtaccaggagcagcaagcaaaacaatgtaaatccttttaaggcccaggctcaaaattagtataatattacttctacccgattttattggacaatgcaaattatactacgattctgaatctgaatccagatacagaatagaaaatagactccaactcctggtggaaggaattgtaaagaatcatggctgctgtttttttgttttttttttttttgagatggagtctcactctgttgcccaggctggagtgcagtggcacaatcttggctcactgcaagctctgcttcctgggttcactccattctcctgcctcagcctcccgagtagctgggactacaggcgcccgccaccacgcctggctaattttttttttttaatagagatggggtttcaccgtgttagccaggatggtctcgatctcctgaccttgtgaaccacccgccttggcctcccaaagtgctaggattacaggcttgagtcaccgtgcctggccgagatcctcaattatagtggcagcatactgctttaggctccatggatgactaaactaatttcaaacatataatgctgtttactgtgaaatgccaactgaaagtcattgtttaattttatgtaatttacaatacttactatacctcaataaaactataattattaagggctggcatcggttgctgagaggtggaaggagtacctctctgcagcgtgttagctcaggttcaaacaggacagggcctcaatttcagcagcttttcagaaaatggcctggatccccagcctgaatcatcatcccatggctggagaatgtggacaggttatttaattaagaaactaatgataaaccaagggctatgggaattaagaactatggctaaaaaagaaatgtttagagtgatgcagaatggccgattaaaagcagctgcactccccagcactcaaggagaggaatgaaaaggggcaggtgaattcagcaccttcaactgagatacccaggttctcccattgggactgactggaagaacagctcgccccatggagaatgaagaaaagtggagagagggtgtgatggcccagctgagagcagcgtggagccaaaggaacccccactcccagccaagggaagcagtgagtgattgtccaatcctgctcaggaaacagtgcttctcctattgatctttgcaacccatggatcaggggatccccttgtaagcccatgccaccagggccttgtgtctgatacacagagctgtggagtctcagcagatcagctgctcaggcacacacagaaacccagacgttttacgtactctggccccgagatcctcagcaaggtgggaaatctgtccatacatattttggaaaggggctgaatccagggagccaagcagtgtcactctgtgggctccatttccacggtacctcacaagttaagacccattggcttggaatcctagccaaccaagagcaacaggttggattccacctcagatgggtctgagttccccgggaggtggagaggggcagccagcatcactgcagtttgtagactcagccactcctgcctgccagctatggaaaatacaggtggtcaggaggaggaagtgttccctgcaacgcagcacacctggtctaccaaaaagcagcgagactgcttctttggatgggtccctgatcccatgtctcctgactgggtaagaactcccccatgggggtctccagccacttcctacaggtgtatgtagacttgctacaggtcagtatccccctgggatggagcttccaaaggaaggagctggctgccatctttgctatttcacagccttcactggtaatacctccaggtagacgggagaaagtcaggcgactggggtcttgaatggaccaccagcaaattgcagaagcactatggtagagtggcctgttaaaggaaaaacaaacacagagaaaacaacaactgctcaaagaaatcagagaagacacacacaaaaaatggaaaaacatcccgtgctcatggatgggaagagtcaatatcatgaaaatggccatattgcccaaagcaatttatggatgcaatgctattcccattaaactgctattgaaattcttcacagaattaaaaaaaaactatcttaaaattcatatagaacaataaaagagcccaaatactcaagacaatcccaagcaaaaagaacaaagcaggagtcatcccgctacccgacttcaaactatactatactacagggctacagtaaccaaaacagcatggcactagtacaagaacagatgtatagaccaatggaacagaatagaaaactcagaaataagacctcacaccaacaaccatttgatctttaacaaacttgacaaaaacaagcaatgggaaaaggactccctatttaataaatggtgctggagtgctggctagccatatatagaaaattgaaactggacttcttccttacaccatatccaaaaattaactctagatggattaaaaacttaaatgtaaatccccaaagtataaaaactctagaagaaaatctaggccataccattcagaaaataggcatgggcaaagatttcatgatcgaaatgctaaaagcaattgcaacaaatgcaaaaattgacaaatgggatgtaattaaactaaagagctacagaatgggagaaaatttgtacaatctatccgcccgacaaaggtctgatattcagattctacgaggaacttaatgaaatttacaagaaaaaaacacacaaccctgttaaaaagtgggcaaaggacatgaacagacacttctcaaaagaagacatacatgcagtcaacaaaaatacgaaaaaaaaaagctcaacatcaccgaccactaaagaaatgcaaacaaaaccacaatgagataccacctcacgccagtcagaatggctattattaaaaagtccaaaaataacatgctggcaaggttgcagagaaaaaggaatgctttttacacggttagtgggtgtgtaaattagttcaaccatgtagaagacggtgtggcaattcctcaaagacgtagaggcagaaatagcatttgacccagcaatcccattaccaagtatagacccaaaggaatataaatcactgtcttacaaagatacatgcacgtgcatgttcactgcagcagtattcacaatagcaaagacatgcaatcaacttaaatgcccatcaatgatagatcagataaagaaaacgtggtacataaacaccatggaatactgtgcagccataaaaatgaagaagataacatcctttgcagagacatggatggaactggaagctgttatcctcagcaaactaacacaggagctgaaaaccaaacactgcatgttctcactcataaatgggagctgaataatgagaacacatggacacatggtggggaacaatgcacactggggcctgtcaggaaggaggggttgggagagggagagcctcaggaagaatagctaatggatgctgggcttaatacatagggatgagatgtctgtgtagcaaaccaccatggcacaggtttacctatgtaacaaacctgcatatcctgcacatgtacccctgaacctaaaataaataatcacattttattgaggtataacatagatggtaagttgcactaatcaagtgtgtatcttgatgatattacacataagtatatatgcatgtaaccaacacctctgtcaatgtattggtgtatgactgatctccgattaattgttgtaaagatataaaatatcaagattaatgtttttcatatagctatcaatgcttcctgtaccacttactgtgaagagcataacttccccaatgaattgtagaggtgtgtttattgcaaatcaagtgaacatatatgtataggtttgtttctcagctttttctccttttattatgacttaatgacttgtctatacttaagtccagaccacagttttaaatattatggctttatagtgagttttgaaaacttgtttataagtcccccaactttgtacttctttgtttaaaaactatcttggctcttctagattttttgaatttccatatacattttagaatcttcttggcaatttacacacacacacacacacacacacacacacacacaacctgctagtattttgacttgggcattcactacattgcttaatttagggagaactgacatgtaaaaatattgagatttccaactcaagaacataatatatctctctacttatgtcttctttgacttctttttgcaatgtttgcagtgtacaggttttacacatttttttttttttgagacggagtcttgttctgtcgcccaggctttagtgcagtggcgcaatctccgctcactgcaagctctgcctcctgagtttgcgccattctcttgcctcaacctccagagtagctgggactacaggcgcctgccaccacgcccagctaatttttttgtatttttagtagagacggggtttcatgtgttagccaggatggtctcgatctcctgacctcatgatccgcccgcctcagcctcccaaagtgctgggattacaggcgtgagccaccgcgcccaccctacacatcttttgttagttttatttctaggcattcgataagtttttatgctgttttaagtaatatttgaatatcttcattttctgattatttgctattggtatataggaacataattaatttttgtatattgactttagttttgtttttaaattttaagttctgggaaacatgtgctgaacgtgcaggtttgttacataggtatacgtgtgccatggtggtttgcagcagctgtcagcccatcatctaggttttaagttgtgcatgcattaggtatttgtcctaatgctctctttcccctttcccccaaccccgacaggcctctttcccctccctgtgtccattctcattattcagctcccacttatgagtgagaacatgcggtatttggttttctgttcctgtgttagtttgctgaggatgatggtttcagcttcatccatgtccctgcaaagggcatgaactcattcctttttatggctgcacagtattccatggtgtatatatgtgccacattttctttatccagtctatcattgatgggcatttgggttggttccgagtctttgctattgtaaatagtgctgcaatgaacatatgtgtgcatgtgtcttaatagtagaatgatttataatcctttgggtatatacccagtaatgggatggctgggtcaaatggtatttctggttctagatccttgaggaatcgccacactgtcttccacaatggttaaactaatttacactcctgccagcgtgtaaaagtgttgctatttctccacatcctctccagcatctgttgtttccagactttttaataatcgccattctaactgacatgagatggtatctcactgtggttttgatttgcatttctctaatgaccagtaatgatgagcttttttttgtatgtttgttggctgcataaatgtcttcttttgagaagtgtctgttcatgtccttcacccactttttgatggggttgttttcttcttgtaatttgtttcagttatttgtagattttggatattagccctttgtcagatgggtagattgcaaaaattttctcccattctgtaggttgcctgttcactctgatgatagtttcttttgctgagcagctctttagttgaattagatcccatttgtcaattttggctgtcgttgcaattgcttttggtgttttagccatgaagtctttgcccatgcctatgtccttcgtggtattgcctacattttcttctagggtttttatagttttaggttttatgtttacatctttaatccatcttgagttagtttttgtataaggtgtaaggaagcggtccagtttctgttttctgcatatggctagccagtttccccagcaccattgattaaatagggaatcctttccccattgcttgtttttgtcaggtttgtcgaagatcagatggttgtagatgtgtagtgttatttctgaggtctctgttctgttccattggtctatatatctgttttggcactagtaccacgctgttttggttactgtagccttgtagtatagtttgaagtcaggtagtgtgatgcctccagctttgttctttttgtttaggattgtcttggctatacgagctctttttggttccgtatgaaatttaaagtagttttttttagttctgtgacaaaagtcaatggtagcttgatgggaatagcattgaatctatgaattactttgggcagtatggccattttcacaatattgattcttcctatccatgagcatggaatgtttttgtatttgtttgtttgttttagacagggccttgctctgtcaccgcaggctggagtgcagtggcacctgggctcatgcaattcacccacctctgtctcccgtgtagctgggactacaagcaggcaccaccacacttggctaatttttttaaaattaatttttgtagacagggagtctcactggtctcactggcccaggctggtctcaaactcctgggttcaagcagtcttcccacctgagcctcccaaagtgctggtattacaggtgtgagccaccacacttggccttgtatattaactttatatctagcctccttcataaattcacacattcattttaataattaatgtgtagattccctgggattttatgtatacaatcataaagttactactttattcccagtttttatacttttttctttccttattgaattatctaggactttcactgtaatactgaatagaaatggtaagaggagacagccttgccttattcccaaactcaggtggaaggaattttatacttcactatttgaaatgatgtttgctataggcttctgtagtcattctttaccagattcagacaatccattttatttctagtttgctaaaagttttcaatcatgaattgctgttgagtagattggatattttttctgcatctatcaaggtaatcaaaatgtttttgtgtttttccattaatgagattttcaaatgttaagccgaccttttttatttttggaataaaatccctttggtcttaatgtattatcgttttatatatcactagattctgtttgctaatattttatttagaacttttcatctatgtgcatgagtgatatgaaattttctttccttgaaatgtctttatctgttggtctacatttaccttagctttggtgtcttggataactcctatctgctaaactcatcttcatcctccatcaggatgaatatgatggatatgtttcagggtaatggcaaaaggaaagagctagagtggaatcttacaagtgcttttgcaaggctctcctttgtgacatcccattgaccaaatcaactcacataatagagcccaaatttagagtgaaagggcactacaaggtgaaatgtgagggccgggattcaggaaaagatgaagaattgggaccactgatggaatctttctaccttattctcaggcagggaagcatttttatacatgcagatagtttacaagaaataactaatatatagtcagaaactcaaggcttcagcagttgtataaaaatgcatttgtaaatacccaaagaccttgaagagaaggatctgacccacatctcacccaggttatgctactcccagctaagacatgattcgaccacacccttggccaattttgaaaattgtttcaaactatttatttgaggtggaattacttttcttctcccataatgggaacagtcatggagcaatgtgaccagggtccattggatgggtcataccacttgagggcagcgatccccaaattcccaattccatctttatgggtaaagcatctcttgattgctaatattgttttttaaagctggttgagctaataactgtgagttaattatggcatgtctaaactgagccaattttcttttagtagttttggtggtgcctaatatcagtttgggaagacttaatattagctggggtgtttttgacagccaaaaacctcacttagcatataaagacattactatttccttgtggggtgatggctagactattgatttctatccgttattaaactgttatctccttagggcattgacaaaagtactaataagtcactgatttctttaccatttttaatcagagtatccaaaaaggaggtgataaatcatgtgttttaataaatgccacaaatcatgagccacccaaaaagtaaatctactgtccatattaatatttagtctttcatctttgccagagcgcagccccaaatctaagctactagttcagctacctggacaggccgagaattaggccatggagcacttcagtcattgcatgttcaatgacaacagcatattctgcacttggagtgcctttgtcatttttgagaaccatccacgatgtatattaaatcaaggttgactcaaaggtacatgattcaaatccgggtatacttaacttctgagaggatgctaaacagtcatgtgattcctctttattcttataagagaataaatttgcagggttacattttgaacaacactgaatatgcaaagcagaccttacaatttcctaagtggtaaatttactagtggagaaatgtcagatgctgccttgaagtagcaaaaactttagagatgttggacccatagagttagtggacaaacaagcactgtggtggaagcatcaagaagtttggccactgctaccacctcatgcaggtacagagggtgtacctttgcttccaaatcaaggaatgtactaagataggcagagagaagagttgagcagatttaggaaaaccgaaggtggaggttgttgcaagaaggctttcacaggaaggggaatatcacactctggggactgtggtggggtggggggaggggggagggatagcactgggagatatacctaatgctagatgacgagttagtgggtgtagcgcaccagcatggcacatgtatacatatgtaactaacctgcacaatgtgcacatgtaccctaaaacttaaagtataataaaaaaaaaaaaaaagaaatacggaaaataagaaaaaaaagaaaagaaggctttcacagagtagcattttctacttttgcatcacaaggaagttgcatcagaaagtataaacttagtaagcccatgcaaaggctgagctatgagaaaaatcagatatacaattacctacagtcctaaaatcttcttagccatcttttgatttctgttcttggtagaattgaatgctctttattctggttgaaaacagaaactgtctatctggtgacagcttgtgaccagaaaaatgtagattcttggcagagttcaccttttctctagattctttatgtcccttttcacctactttgaataagaggtatttggatcctttagtaaactacttagatcaggaaacacagcagtaaatcatcaatatattgagtctctctctctctctatataattataaaaagtatatatacacatataattataaaaagtatatataaacatatataattataaaaagtacacacacacacacacacacacacacacacacatatatatatatataattttttagacattgagagaactaggaaggggattcagagaatccctaaagtttaaccctccaggtatatttgtcttcccaggaaaaagcaaatattgcctgtttttcttttcttttctttttttttttttttgagttggagtcttgctgtgtcacccaggctagagtgcggtgatgcaatctcggctcactgcaacctccacctccgggcttcaagcgatactcccgcctcagcctcccaagtagctgggattacaggcacccaccaccatgcctggctaatttttgtatttttagtagagacggggtttcaccatcttggccaggctggtcttgaactcctgacctcgtgatccacctgcctcagcctcccaaagtgctgggattacagacatgagccaccacgcccggccaactgttttcctatatatgtacgctagagaagcctgcacataaattactgcagtgagatatttactggttgagagaatgaagaacaggacagtattctaatggttgcatgatatttcattagtgctatgatgaacctctaatgttggacatgtaagtgtcactattatcaataatacaacaacaaatatctttgggtgtaaggctttttctgtacagattgttaggagtgaaattacctagttgaagagaatgaatatttttagggttcttaatatatattgccaaatccaagagcaattgtattactgtatcaaaataaatcaaagtttttaatgtcatgccttattttgccagcattggattttctcattaaaaggaaaagggctaatttcatgggcgcaaatgtcatgtcactgttgttttgacttctttattggcgacactgaatattatgtaggttgttaatcagtttgattttctcttttatggattgtttatgtccttggcccatttatctataagatgagggagtaatatttaagttgttgttaatgaattattaatttattatcctaggcatagtccccaacagtgcatttttctgaaaaaatattttcccctgttgttcattatagcatttttcaacagaaatttcagaattttatgaagttaaacctaaggctatagatcttccattgattcaacacttttagttcttcctcattcaaagaattaaaattcacttaaatttctcatagatgtttgtagtttttaatatgtgttttctaaatgtatatggattttaggtaagaaatttcatgaattctaaagtatatgaaatgttttatccttcctctctgccactatgcagattcggagtgttcatctttttgacgtattatttcctcctaacatagataaccaatttaataaatggatgactttgataccttaatgttagtgttctccatattaagccagtaaacattgttctgacagtaccatactaatcagtttttgaaattgtgtcatttttgttgttgcacagagatatatacatatgtgtgtatgtttcagaaagagatatttcctgaaaaaattgttggatttgtatagtgatattaattatatttcagataattactatttttcattgaaaaggtatatatatatatacacacacacacacttaccagtatatatatatcttcattaaaaaattaggagaacgggtgagccaaaaaagtttccatattgttacgagttatttataaattgatataatatgtttatctttttctgtcatgcatacacacacaatcatagtgtatactttttgcatttatttgtttacatagtgcttaggtagaatgtaatattcaaatcactatctaaaagacatacctaatcagaattaaatttaaataagaagcaatatgaattagatttaaataagaaccacattaactgtgaattatgatttggaacaaatttacttaaagttagttaaccatctaatttacttttctgatagctttaaacagtgtgtatttacaatagaggctaatctgagtagtcaaacacactttgtggactatttgaaaaaccacagtggattagaacttgaaattggcatacgcttgtattccctgagtctcccctagaagatgctagtgagagacaaagtaatagaaagtaataaccattttaggttcctcgtggaaatggcttatgttggtgccatgtaactatggaaaatacgtgtttctcttttttaggaagtcgtacagtttctagacaagaaacatccaaaccactatcgagtctacaatctatgcagtgtgtaccttactctgtattttgctactgtagatagaaaacagattactgaatgtaagaagatgattttgttttttacattgcatttaatcataagtatttggtggtggtgaggaaggaatttaaaaatccccgtcttggactggccccatttggtagaaggagttagcccaggagcacaaagtaccctatgaaggaggcagctctggcaggaccaatgaggctagagtgaaggcaaaccattttagggaagatctgttctagtgatattaggtttaggaacatctgtctgtttttcctgccagattgtgttatgaggacatagacaatttaacaaatgagtcctctgacccattagcagtgggttgtgatgagagcagggccctaggtgggaaaaaagcaaactctttagaaaataggttgcaacccagcttaccactctgtcttgatttttttctctacctgtatactcaatagacagggggcaatcatcaaggatgttcatcaaggatattggtctaaaattctcttttttgcttgtgtctctgcccggctttggtatcaggatgatgctggcctcataaaatgaggtagggaggattccctctttttctattgattggaatagtttcagaaggaatggtaccagttcctccttgtacctctggcagaattcggatgtgaatccatctggtcctggactctttttagttggtaagctattgattattgccacaatttcagctcctgttattggtctattcagagattcaacttcttcctggtttagtcttgggagagtgtatgtgtcgaggaatttatccatgtcttctagattttctagtttatttgcgtagaggtgtttgtagtattctctgatggtagtttgtatttctgtgggatcggtggtgatgtcccctttatcattttttattgcatctatttgattcttctctctttttttctttattagtcttgcctagcggtctatcaattttgttgatcctttcaaaaaaccagctcctggattcattaattttttgaagggttttttgtgtctctatttccttcagttctgctctgattttagttatttcttgccttctgctagcttttgaatgtgtgctcttgcttttctagttcttttaattgtgatgttagggtgtcaattttggatctttcctgctttctcttgtgggcatttagtgctataaatttccgtctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgctctgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcactgatctgtctaatgttgacagtggggtgttaaagtctcccattattaatgtgtgggagtctaagtctctttgtaggtcactcaggacttgctttatgaatctggatgcacctgtattgggttcatatatatttaggatagttagctcttcttgttgaattgatccctttaccattatgtaatggccttctttgtctcttttgatctttgttggtttgaagtctgttgtatcagagactaggattgcaacccctgccttgttttgttttccatgtgcttggtagatcttcctccatccttttattttgagcctatatgtgtctctgcatgtgagatgggtttcctgaatacaacacactgatgggtcttgactctttatccaatttgccagtctgtgtcattaattggagcatttagtccatttacatttaaagttaatattgttatgtgtgaatttgaacctgtcattatgatgttagctggttattttgctcgttagttgatgcagtttcttcctagtctcgatggtctttacattttggcatgattttgcagcggctggtaccggttgttcctttccatgcttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttctttaagaatgttgaatatcggctcccactctgttctggcttgtagagtttctgccgagagatccgccgttagtctgatgggcttccatttgtgggtaacccgacctttctctctggctgcccttaacattttttccttcatttcaactttggtgaatctgacaattatgtgtcttggagttgctcttctcgaggagtgtctttgtggcgttctctgtatttcctgaatctgaatgttggcctgccttgctagattggggaagttctcctggataatatcctgcagagtgttttccaacttggttccattctgcccgtcactttcaggtacaccaatcagacgtagatttggtcttttcacatagtcccatatttcttggaggctttattcgtttctttttattcttttttctctaaacttcccttctcgcttcatttcattcatttcatcttccatcgctgataccctttcttccagttgatcgcatcggctcctgaggcttctgcattcttcacgcagttcttgagccttggctttcagctccatcagcttctttaggcacttctctgtattggttattctagttatacgtttcgtctaaatttttttcaaagtttttaacttctttgcctttggtttgaatttcctcctgtagctcgtagtttgatcatctgaagacttcttctctcaattcgtcaaagtcattctccatccagctttgttctattgctggtgaggaactgcgatcctttggaggaggagaggcgctctgctttttagagtttccagtttttctgctatgttttttccccatctttgtggttttatctacttttggtctttgatgatggtgatgtacagatgggtttttggtgtggatgtcctttctgtttgttagttttccttgtaacagacaggaccctcagctgcaggtctgttggagtttgctagaggtccactccagaccctgggtatcagcagcggtgtctgccgaacagtggtttttcgtgaaccgcgaatactgctgtctgatagttcctctggaagttttgtctcagaggagtacccggccgtgtgaggtgtcagtctgcccctactggggggtgcctcccagttaggctgctcaggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcgggcctccttgagctgtggtgggctccacccagttggagcttcccggctgctttgtttacctaagcaagcctgggcaatggcgggcgcccctcccccagcctcgctgccgccttgcaatttgatctcagactgctgtgctagcaatcagcgagactctgtgggcgtaggaccctccaagccatgtgcaggatataatctcctggtgcgccgttttttaagcccgtcggaaaagcgcagtattggggtgggagtgacccaattttccaggtgccgtgtgtcacccctttctttgactaggaaagggaactccctgaccccttgcgcttccccagtgagccaatgcctcgccctgcttcggctcgcgcctggtgcgctgcacccagtgacctgcgcccactgtctggcactccctagtgagatgaacccggtacctcagatggaaatgcagaaatcacccgtcttctgcgtcgctcacactgggagctgtagaccggagctgttcctattcggcctccttggctccgcgatctcttgcgtggtttctaactaccctgcaataatataatgatagtctgctagaaagttaaaaattacacctattaaacaaaagtaagttgagtttaggtgacatgagatggataatctgctcatatgcttatgtttttgagattcttaagtttattttagagcagcagaagcaacttggaaagctccttttgaagatggatagggaatttctaataagatattttatgttgctcataacttcatcatttactatgttattatatatagagatatgacatacatattatttattttaggtgaaagagcttatgatcctaagcacttccataatagggtcagtagaatcatgatcgatgatcataatgtccccactctacggtaagttttatgctaagttgactatgagaagggggctaaatctattgggcttgattttttgaaaatattttaactcaactaaaaatcctaaccttgaaatcagggagatggtagcattctccaaggaagtgttggagtggatggctcaagattctgaaaacatcgtagtgattcactgtaaaggaggcaaaggtaataacgttttcctttttattcctcccattctaaagacgtgtaaggatatgtaaagcacaagaacaagatacctgttgctattaataagtattagtaattgttagcatttaaaagtattagctgtaagactgaaagaagggaaggagaaaggaaagaggagaggaggaagagtaggagatagggagaggataaggaagggaagaaagtagggaaaaagaactaaggagggttgagcatattttctcttgtttttctatttggatatctttatttttggtttgccagtttatatctctcaaaatacaaagtctttaattttggagtgtcagagtagttttatttaaggctgctcttttttatttttaaattaacaaataaaaatcagtatattcatggtataccacatgatgttttgatatatgtaaacattgtaaaatggctaaatcaacctaattaacatatgcattactccacatactttttacttttttgtggtgagaacatttaaattgtactctctcagtaattttcaaatctatattattattaactgtggtcaccatgttgtgcaataaatttcctgaacttattcctgtctaactgaaattttgcatcctttaactgacatctccacaatccctcctttttgttccccccagcccctggtaaccaccattctactctctgcttctatgaatttgacatttttagagtccacaaagaagtgagacatccaatatttgtctttctatgcctggctcctttcacttagcataacgttctccaggcttatccttgttatctcaagggacaggatatcctctaacgccgaacagtgtgttcttatttatatataccaggtattctttatctgttcttccattgatgacatttagattgactccatagcttggctattatgaataatgctgcagtgaacatgggagtgcagatttcattttctttggacatatacccagaagtggaatctccaaatcatatggtagttctatttttttatttttagttttttgaggtgtccctatgctgttttccataataactactaatttacactcacaccaacagtgtacaagagggttctcttttctctacatcctcaccaactcttcttttgtctttttgttaatcaccatcctaacaggtatgaggatatctctttgtgattttaatttggttttcctgatgattaatgatgttgagcattttttcatatacctcttggccattcatatgtcttcttttgagatatatcttttcaggttctttgcccattttttagagaagtaacttgttctcttgttattgtgttgtttgagttcctttaaaaaaaaaattaacctgttcttgaatatatgctttgcaggtatttttctcccattctgtaggtggtctctttataattgtttcctttgctgtgcaaaagcttttcagtttgatacaatgtcatttgtctattttttcttttgttgcctgtgcttttcagtcatatccaaaaaatcttggcccagaccagtgtcaagaagcttttcccctgtgttttcttctagtagttttccagtttcaggtttcacagttaaatctttactttgagttgatttttgtacactgggtgagatagggtgcagtttcattcttctgcaagtggatgtccagtttccccagtattgtttattgaagagactgtcctttcctcatcgtggattcttggcacctttgttgaagatcagctgaaaaatgcacggatttattctgggctttctattctgttccattgatctatatgtctgtttttgttccagtaatatttaaggttgttcttaaacttggtgagaatcttttagattaagggagccaacacagagatgctatttcaaaaattatactggacttatgatagtgtaatgatacaaagaagtttatattggtggggttaaaatggggggaaaagccacttgtaaatccaatcaatttaagttcagttagattttctctcattcaggtttaggctttgaataatcatctaagtatatttcacaatttttgataaacataaagaattaccttcttagagggctgtaaaaccatttttatatcaaattccaggaaaacataacactgtaaactgacttatataattcaataaaatgaagttttagttttattgagaactagtttcaagcccattagttaatatacaggttcagtgtttagctctacaggtttgaatattctgtataaagtggcaatttacaataccatagttaaattaagaatatagaagttgaatcatttgaagttcccagttttttaaccatcttttggtttaaaaatggccatttcacattgcctaacctaacatgttatttttcaagcagtagcatcagttttctattaactgatactaattccttgcttgaaggatttcaaatttgacttttttctaaaaacttttgctgagagggggtttgcataattctgggttcacataatattttgttgatttttttaggttgtttagagaatattcagctggtatgcaccagagaagcctctttttaaaaatgttcattcatattaatcttgctgtcttctgattggttgctgcctgcaggttatcagtagtatcatgagagtagaaatattttattattgatttataggagttctttaaagaatctaaatgccaatttttcttagtattgcaagtatattctcccactgtgttgtcttttaaatttgattgtgatttattttgttgtataaaagcttgtaaatttgtgttttgttttgagacacagtctcgttctgtcacccaggctggagtacaatggctcaatctcagctcattgcagcctcaacctccctgtactcaagtgatcttcccgcctcagcccctctgagtaggtgggattacaggcacgcgccaccacgccggggtaatttttgtattttttgtagagacagggtctccctatgttgcccagactggtcttgaactcctggactcaaatattccactcgcctcagcttcccaaagtgctgggattataggcatgagccattgtgccagcaagaagtttgtaattttgaatgtggtaaaatgtgttaatcgatgtgtttgtatttcatgcttttctgtcacgtttaagaaattcacccctatactgaggtagtaaagatattctacatttcttcaaaaatcttcaagttgcatttttaatatttgggtcttaaatctaattgaaatttgggggaggtttttttttcatatggatagccaacggtcctaacagcatcaattgcatgctattttgttctccatttatttgtgattcctctcaatcatataccaagtttctagaaatattcaaaattgtttctaagttctctatatcacacttttgtaattattgtagccttatattgtagtttgataaaggcagaattgtcttgctcttcttggaacgttattctttcattaaattttaaaatcattttgtcaagttccattataaaacacgcttaggattttcattggaactacattgaatttatagattcactcgagagaactgacagctttgtgataataagttatacatgtgattgatcttgttcattctttaattaaatattttatattttcttcatcatgtctttgcacatcttttcacaaattcattcctacacaaattgtgactgcaagtggaatctcttttttttttttctgttacatttgggttgtttccagtttttactatgataaataatgctgctttttttttttttttttttagacggagtctcactctgtcacccaggctggagtgcagtggtatgatctcgcgcactgcaacctctgcctcccaggttcaagtgattttcatccctcagcctctggagtagctgggattacaggcgcctgccaccatgcctggctgttttgtatttttagtagagacagggtttcaccatgttggccaggctggtctcgaactgctgacctcaagtgatctgcctacctcggcctcccaaagagctgatattacagggtgagccactgcgcctggcccaataatgctgcttttaaaaatacacgtttcttgttgcatatgtggccatatttttgttgagtatgtacctcagactaaaatggttctgtcttaaggtaatgaatcttgaactttatacttgataatgtcacctgtttctaaaacagttgtaccaattttcactccactggtatcgcacactcgaagcattccatatcttccccagtacttgcaattctgagtattttgatttttagccattgggtgtttgtgtgatggcatattatggtggtgttcatttgcatttctataattactaataagattgaagaagttttcttaagattattaagtatttggatatccttttttgtaaagtaactgttaagttttcttacccatttttctcctggattatttgtctttttttctcttgatttgcagttttttatatattctgatttccattctgttattggtcatatatgtatttcaagaaaacttttctgctctgtgatttgccttttctctctcttaggagtatcttttggttaacagaagttcttagttgtattaccatcataggtattatgctttctctttataaagtttgtgtttttgtgtcctgattaagaaaattttccttgagtttaaagacattctactactatattttcttctagatggttcattcatttaaaaattgatttataggtgtggtgtgaggaagaggttaagtttcatctttttccatatatggctatccaattattccagcacactggttgagaagatttttatttctttacttccctgcagaacatgagtctgcttctgacctttctattctgttcattgatttttcatctgtgtgccaatagcacaaccatcttactgtagctttctaatagtccttatttccagtcaagtgaggacaatcatctttttcttcataattgtttgtgtattttaggccgtctacatttccatataaatttgggaatcaaacaaaaggcagcagaaacctctgcagacttaaatgtccctgtctgacagctttgaagagagtagtggttctcccagcacggagtttgagatctgagaacggacagactacctcctcaagtgggtccctgacccccgagtagcctaactgtgaggcaccgcccagtaggggcagactgacacctcacacggccgggtacccctctgagacaaagcttccagcggaatgatcaggcagcaacatttgctgctcagcaatatttgttgttctgcagcctccgctgctgatacccaggcaaacagggtccggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagcagaaaagctgaaaattctaaaaatcagagcacctctccccctccaaaggaacacagctcctcgccagcaaaggaacaaagctggacggagaatgatttcgaagaattgagaggagaaggcttcagacaatcaaacttctccgagctaaaggaggaagttcaaacccaatgcagggaagctaaaaaccttgaaagaagattagacgaatggctgactagagtaaccagtgtagagaagttcattcatcatactgaatgggcaaaaactggaaacattccctttgaaaactggcacaagacagggatgccctctctcaccactcctattcaacatagtgttggaagttctggccagggtgatcaggcaggagaaagaaataaagggtattcaattaggaaaagaggaaatcaaattgtccctgtttgcagatgacttgattgtatatctagaaaaccccatcatctcagcccaaaatctccttaagctgataagcaactgcagcaaagtcttgggatacaaaatcaatgtgcaaaaatcacaagcattcttatacaccaataacagacaaacagagagccaaatcataagtgaactcccattcacgattgcttcaaagagaataaaatacctaggaatccaactgacaagggatgtgaaggacctcttcaaggagaactacaaaccactgctcaacgaaataaaagaggttacaaacaaatggaagaacattccatgctcatgggtaggaagaatcaatattgtgaaaatgggcatactgcccaaggtaatttatagattcaatgccatccccatcaagctaccaatgactttcttcacaaaattggaagaaactactttaaagttcatatggaaccaaaaaagggcccgcattgccaagtcaatcctaagccaaaagaagaaagctggaggcatcacgctacctgacttcaaactatactacgaggctacagtaaccaaaacagcatggtactggtaccaaaacagagatatagacatatagagatatggaacagaacagagccctcagaaataataccacacatctacaaccatctgattttgacaaacctgacaaaaacaagaaatggggaaaggattccctatttaaaaaatggtgctgggaaatggtgctgggaaaactggctagccgtatgtagaaagctgaaactggatcccttccttacaccttatacaaaaattaattcaagatggatcaaagacttaaatgttagacctaaaaccataaaaaccctagaagaaaacctaggcaataccattcaggacataggcatgggcaaggacttcatgtctaaaacaccaaaagcaatggtaacagaagccaaaattgacaaatgggatctaattaaactaaagagcttctgcacagcaaaagaaactaccatcagagtgaagaggcaacctacagaatgggagaaaatttttgcaatctactcatctgacaaagggctaatatccagaatctacaaagatctcaatcaaatttacaagaaaaaaacaaacaaccccatcaaaaagtgggtgaaggatatgaacagacacttctcaaaagaagacatttatacatccaacagacacatgaaaaaatgctcatcatcactggtcatcagagaaatacaaatcaaaaccacaataagataccatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcaaggatctagaacgagaaataccatttgacccagccatcccattactgggtatatacccaaaggattataaatcatgctgttataaaggcacatgcacacgcatgtttattgcagcactattcacaatagcaaagacttggaaccaacccaaatgtccatcaatgacagactggattaagaaaatgtggcacatatacaccatggaatactatgcagctgtaaaaaaggatgagtttgtgtcctttgtaaggacatggatgaagctggaaaccatcattctcagcaaactatcgcaagaacaaaaaaccaaacaccgcatgttctcattcgtaggtgggagttgaacagtgagaacacttggacacaggaaggggaacatcacacaccagggcctgttatggggtggggggaggggggagggaaagcattaggagatatacctaatgtaaatgacgagttaatgggtgcagcacaccaacatggcacatgtatacatatgtaacaaacctgcacgttgtgcacatgtaccctagaacttaaagtataaaaaaaaaaaaaatttgggagtcagctggtcaaatacacacacctgatagaaatttgtttggaattgcgttgaatctatagattggggagaattgaatctttacaatattgacccatccaacccatgaagagagatgttctctcattcagttaggtttccttccatttctctttacaatgttttctcattttctgtgtagaaagcttgcatatttttgatgagatttattcctagatatttgatattttgtggttatttaaatgatatccctttaaaatgtttattttctaaatgttgttgatttaaatgcagttcattttattcattaatcttgtatttagcaacttgactaaactcactttttgtttgtttgtttgtttgtgtgttttgagatagggtttcattctgtcacccaggcgggagtgcagtgatgcgatcatggctcactgcagcttcaacctccctgggctcagggaatccctcccacatcagcctcccgagtagctaggactgcaggcaggtgccaccatgcccagctaatttttttatttttttgtagaaacggggttttgccatgttgcccagattggtctcaaactcctgggctcaagtgatctgccagcctcagcctctgcctcctaaaatgctaggattacaggcctgagccattgtgcccagcctaaactcacttattagttctactaaattatctatagattcttttggattttatagtacacagttatatcatgtgaaaataatacattgtattttttccttttcagtcattttcccccctagcactggctagaaccttcagtacagtgttgaattagaagtggcaacagcagccatcagtgtacacttctattctcaaaggaaaagctttcagtgtctctccaattgctttacgagcatgtgtgtgtgtgtgtgtgtgtgtgtgtgtgtgtgtgagctaccatttatcagatgaagaaattccttagccaggcgccatggctttcgcctgtaatcccagcactttgcggggcccagtggggcacatcatttcagaccagcctgggcaacatgatgaaaccccatctctactaaaaaataaaaaattaaccaggtgtggtggtgcatgcctgtaataccatctactctagaggctgaggcacgagaattgcttgaactcaggatgcagagattgcagtgagccaatatcacaccactgctctccagcctaggtgacagagcgagacattggctcaacaaaaaaaaaaagaaagaaaaagaaaagaaaaaacaatgtctttagtttgctgagagagttttttttttaatcatgaatggatgttgaatttttccagatttttctgaatctttgagatgataatttttcccctttatcttataaataaatgtggctaattacatgattgattaagtggtaaaccaacatatttctggaataaatgtgattgagttgtgctatactattttattaaataattattaaacttttttttattaaattcctgggttctatttgttaatatttgtttaggattttcaaattcatgtcaccagtgtgattggttgtaattttcctttctcatagttttttcaaatcttggcttcataaaatgagttagattttattttctctttttttattccctcgatgaatttatgcgtgctgtttttttttttctttttaagtgtacggtgaaattcaccagtgaagctacatttgtctagagttttctctggggagaagtttttaaattatcgctcagtttcgtatatagaattctctctaattttatttccttagcctgttttggtaggttattgttttcccagcatttgtccatttaatctaagtttgcgaatgtcttggcatcaaattattcacaatatcattttaccattttaatgtctacaggggcattccctttttattccttacattattttcttggtgccttctccctttgtttcttttgattagtctcaccagggaattatcaattttactagtcttttaaaagtaacaaatgtggctgagcgcggtggctcatgcctgtaatcccagcactttgggaggccaaggcgggcggatcacgaggtcaggacatctagaccatcctggctaacacggtgaaaccccgtctctactaaaaacacaaaaaattagccgggtgcggtggcgggcgcctgtagtcccagctactcgggaggctgaggcaggagaatggcatgaacccgggaggcagagcttgcagtgagctgagatcgcgtcactgcattccagcctgggttacagagcgagagtccatctcaaaaataaataaataaataaataaataaaataacaaatttttggccttactaatggactctattatttactttttatttcatgaattagtattatatttagtattttcttttgtattccatgggttaatttgttcttttcctgacttcttgagatgaataattcttagagtgtcgaccactctgttttctgtttagcatttaaggctatacattttcttctaagagttgctttagcttcgtcccacaagttttcatatgtaatattttcattttattgggttcaaattattttccaattttcactgtgcttggtgtttttttttttttttgacccgtgagttgtatagaagtatacttccttatttccaaacataggagacttttgcatttatctttaagttttttatttgtgaagccaggcgcagtggttcacgcctgtaatcccagcaatttggcaggccgaggaggtggtttacctgaggtcaggagttcgagaccagcctgaccaacatggagaaacctcgtctctactaaaagtacaaaaattagccaggtgtggtggcacatgcctgtaatcacagctacttgggaggctgaggcaggagaatcgcttgaacccgggaggcggaggttgtagtgagccaagaacacaccattgtactccagcctgggcaacaagagcgaaactccatctgaaaaaaaaaaaaaagttttttatttctggttgtattgtgctgtggacacagaacatactattttttttttcttccaaatttgtgtagacttggtttatggcctagaatttggttgatattgttaaatgttttctgtacacttgaaaaaaacacgtattatgcattgttgagaacaatgttctatgtacgtgcatttgttaatttatttaactcttctatattcttactgacttgtgttttggtttgattgaattttgataattttttccttctcactctctcccattgccttggaagttatatactccttttctatttttttagtaattactgtaaagatttcaacctgaatccttgatttagctattaatttttgtttatgttgagcctgcatctagagatcttcctaaactctctcaactctctcgttagattaatgagttattctatagatttactgactacacggacttactacactggctaggctctgcagtacattgttaaatggaagcagtgaacagagggcatttttgcttaattccaggctttaaagaaaatgctatcaatattacatcattaatatgatgttcctggtaggtgttttggtagattccctttgttgagttaaagaagtgtcctagtttttattaatttttaaagtcacagttgtaggttgaattttagttaatgctttctctgcattaattgacataattgcaaggtatgtctactttaatctgtgaatatgataaattacattaatatagatttctgatataggatgattcttttttgtttgtttgtttgagacggagtctcgccctgtcgcccaggctggagtgcagtggcgtgatctcggctcactgcaagctccgcctcccgggttcacgccattctcctgcctcagcctcccgagtagctgggactacaggcgcccgccaccacgcccggctaatttttttgtatttttagtagagacggggtttcaccgtgttagccaggatagtctagatgtcctgacctcgtgatccgcctgcctcggcctcccaaagttctgggattacaggcaagagccaccgcgcccggcctaggatgattcttgtatttttatttgtttttttaatgggcaaagaaattttttttttttgagcttagttttttggtataatttccactttgattttagatttggaagtacatgtgcaggtttattacctgggtatattgtgtgataccgaggtgtggggtatgattgatcccatcacccaggtactgagcataggacccaatagtttttcaacctgtgtccccttctgctgtgcaccctctagaattccagtgtccattattgccaccttgatatccatgagcatctattgtttagctttcacttataagtgagaacatatggtatttggttttctgttcctgcattaatttgcttaggataatgacttccagctgcatccatgatgctgcaaaggacatgattttatttttttatgaatgtgtagtattccatggtgtatatgtaccacatattcttaagccagtccaccactgatgggcacctaggttgattctgtgtctttcctgttgtcagtagtgctgagaagagcatgccggggcctgtgtctttttgttagaacaacttactttcttttggatgcatacgcagtaataggattgcaatgtcaaatggtagttctaagtttttgagaaatctccaaactgctttccaggtagctgaactaatttacattcccattagcagtgtatacgtgtatactctgcagccttgtcagcatctgttgttttttgactctttaataatagccattccgactggtatgagatataatcatgttgtggttttgatttgcatttctcggatgattagtgatgtggagcatttttcatgtttgttggccactggtatgtcttcttttaagaagtgtatgtttatatcttttgcccatttttaatggggttatttgctttttttgcttaattgttgagtttcttatagattctgaatattaaacctttgtgagatgcatagtttgcaaatattttcacccattctataggttgtctgtttactctgttgataggttctttgctgtgcagaagctctacagtttaattaggtcccacttgtcagttttttgtggcaattgcttttgaaaacttagtcataaattcttccccaaggtcagcgtccagaatgctgttttctaggttttctcctagtattcttatagtttgaggtctttctatctttagttaatttttgtatatggtgaaaggtataggtccagatcattcttttgcatattgctagctcaatatcctagcaccatttattgaataggaagtcatttccttattgcttatttttgttgactttgtcaaagatcagatggctttctgtgtttggctttatttctgagttctttattctcttcctttgatcaatttttttttcctgccagtaccatgctcttttggtttctatagccttatggcgtagtgtgaagttgggtaatgtgatgcttctggctttgttctttttgcttaggattgctttggctattccggctcttttttggttccatgtgaattagatttttctagttctgtgaaaaatgatgttagtagcttgattggaaaaatgttgattctgtatattgcttttggtagcatggccattttaatgatattgattcttccagtccattagcatggaatgtttttccatttgtttgtgtcatctatgatttctttcagcagtggtttgcagttctccttgtagagatcattcacctcctcgattagctgtattcctaagtattttattttttgtgtggctactgtaaagggggttatgtccttgatttggctgtcagcttggacattattggtgtacagaaatgctactgatttttgtacattgattctgtatcctaaaactttactgaagtaatgtatcagttccaagtgccttttggtggagtcttttggattttgaagatatagaatcatatcgttgatgaagagagatagtttgactttttattttcctatttggatgccatttttttctttcttttgcctgattgctatggcaaagacttttactactatgtgaaataggagtggtgagattaggcatccttgtcttgtcccagttgacaaggagaagcgtccagcttttgcctgttacaatgttggctgtgggttcataatagaaggctctgttttgaagtgtattcctttaatgcctagtttcttgagtgtttattgtcaagaaggatgttgaattttatcaaaagtttttttttgcatctattgagatgatcatatggtttctgtgtggtgaatcacatttattgatttgcatatgcagaaccttgcatccttggaatgaagcctacttgaccatggtgaattaactttttgatgtgctgttggattcagtttgctggtattttgttaaggatttgtgtgcctatcttcatcattgagattagcctttagttttctttttttttttttaattgtgtgtttgccaggctttggtttcagggtgatgctggcttcatagaatgaattagggaagaatccctcctggagtttttggaatagtttcagtagaactggtaccagttcttctttgtatatttgatataattcatctgtgaatacatctgatttaggacttttttggttggcgggttttaacttatggattcaattttggagcttgatactggtctggtgagggtttcaatttctttctgattcaatcttgggaagttctgtgttgccaggaatgtattcatttcctctacattatctagtgtgtgtgcatagaggtgttcataatagtctctgaggaccttttgtatttctgtgggattggttgtgatgtcgtctttgtgatttctgattgtgcttatccggatcttctttctttttctttgttaatctagctagcagtctatcaattttgtttatgttttcaaagaaatgacttggtttctttgaatctctgttttaattttggggtctcaattttgtttagttttgctctgattttagttattgtttttcttctgctaggtttggggttcttgtttttctgatttctctcggtgtaatgttacattattaatttgagattttactagctttttgaggtacacatttagcaccataaactttcctattaacactgcttttgctgcatcccagagattctggtatgttgtgtttctgttttcatttatttcaaagaattttttgatatctaccttaattttatcatttgcttaaaagtcattcaggagcaagttgtttcatttccatgaaattgtttggtttttagagatcttcttgatattgatttatatttttattcaactgtggtccaaaaaaaatggttggtatgatttcaacattttttgaatttattgaggcttgcttcatggtggaacatatggttgatcttggaatacattcgctgtgcaaatgagaagaatgtatattctgtggttgatgcatggagtgttctttaggtgcctattacatccagttggtcaagtgttgaatttatgtccgtaattcctctgttagtgttctatctgaatgatctgtctaatgctgtcagtggggtgttaaagtctcctgactattattatgtggctgagtcttttcataggtctagaagtacctgttttattaacctgggtgatccaatgttgggtgcatatatatttaggattgttaaggcttcttgttgaattgaaccccttatcattatgtaatgcccttctttgtccttttttactattgctggtttaaagcctgttttatctgttttaggaatagtgatccctgctctttttggtgttttgtttgtgtgagagatctttctccaaccctttacgttgaacctgttggtgttgttacatgtgagatggtgtcttgaagacagcagacagatgggttttgtttttttatccaacttgccactctgtgacttttacgtggtgtgtttagactatttacattcaaggttaatattgacgtgagcttttcaccctatcatgacattgttaggtggttgctttatactttctgttgtattgttgttttataggctctgtgagctgtgtacttaagtgtgcttttatggtagcaggtatcattcttttatttccatgtttagaactcccttagggatctcttgtaagactggtctagttttaatgaattctcatggcacttgcttctctggaaaaaaagatctttatttgtccttcgctcatgaagcttagtttggcaggatgctcttgattagaatttattttctttaagaattctgaaaatacaccttcccaatctctcctgatttttaaggtttctgctgagacgtctgctgttatcctgatagggctccttttgtatgtgatctggccttaggattttttctttaacgttgaccttggactgtttggtatatgccttggtaatgtccacttttttatagtatctcgcaggtgttctctggctttattgtatctagatgtctacctttctagcaagattcaggaaattttcttgaatgattgcatcaaatatgttttccaggttgttttctttttttccttgtctctagggaatgccagtaatttgtaggtttggtcacttcacataacctatttctcaaagacgttcctcactttttaaaaatagtttttctttatttttgtctgactgcattagttcaaaagaccagtcttcaggctctgaaattatgtcctctacttggtccagtttattgataaatctttccattgtattttgaaattccttaagtgagttttttaattccggaagttctgattgatttctttttaagatgtttatctcttccttcatttgctgaattgatttagaagtttccttttgttgatttcaaccttgaatctcattgagcttccctggaatccatgctttgaattctttattgtcatttctgagttttcattttggtagaaagcattgccagagagctagtgtgatcctttggtggtatcactacatgcaggtttttcatggtgccagaattcttgtactggttcttctcatctggagatgctagcacttctaatttttgtaattgtttttatgtgggtaggattttttctttatcttttctttcctatatcattattattattattattattattattattattattattattattctttccctttccctcctccttaggtgatgtgactttagagcaatgctaggtaggtcttttggccttgcttctatatgcacttctatcagcaggttttatattgggtatgtggtttgacctacaagccagtagatggcggcgatgggtaagagctggctgtggccagtggtgctggctatatacttgctgtttgtttattgggaagagctctctgttgccttaggcaatgagctgattcctggagtacacattaatctgagctccctcctaaaccctaggggaacgggagttaggtgggggtgtgggaggaagatgggtggagccagatggggaaggttccccagtgttgtcctgctctcagtccaggtttgggaaaatgcctgcagcttttccttgtgtcctttcctcacaaagtctccaagtctctcgttaaattagctccaggacttgggagaaacagtgcccctcctcggtccgggttgcttggatccccagtggaaaggtaagacagagggatgctgtctgcctctctcacatactgaggcttcactcgcttttatcagtcgaatgttgtcacaagagctgtttgcctgcgttgtcctcccaaggatctggggtgtccttcataattccagggagttgtcgttttctttcttgaattaaagttcacagagttgatctttatgtactatcttgctatttccaaatggctgaggcatgctaaaagcctgtaatctgccgtcttggaaaaaaatccttgcattcttaagagaaatggcacttggtattgatacgtggtatttctacactgctgaattcactttgaaaaaatatatatatttttatatctacatttatatgtcagactggtataaagtaatcgtctactgtatttatgcagttttggaaccagctattttagtgttactaaatgagttgggaatttttctttcttactgttacccaaaggaatttatataagacatgaattattgctttcgaatagatttagtaaaaacctcatcttgttctttcgtggagaggtagttgagaaatatttttaccgtaaatgtaatttattttccacctgtggggcagaggttgcagtgagctgagatcgtgccagtgcactgcagcctgggtgacacagcgagactgtcccaaaaaaaaagaaagaaaatcaacttaaaatgaactcctggaatatttctgagtgtatttttataccaagcatgttccttgaactaatttttcttttcttttctaggaagaaccggaactatggtttgtgcctgcctgattgccagtgaaatatttttaactgcagaggtatgaaagatgttactacaaactttgtcttaggatgactgagtttgctagttctgaaacatcactggtaggatgttaagatgattattttagtcatggtgcttagtgaaattgtaattggagaagcggttgttaaaaagtctgtttttgatacttccttgtttaacatgcactggttagtagctggcttaagaatctctttgggccaggactagagtgaggtcaatgaggcgcagaatttaagagaatgctaaaaattgcaataattaaaataaatgatttttcatgcaatatttaaaaaataaaaattaatgcaaaaaaaccatgaggtatacaatattaacattttaaataatgacaagacctgatggggcaggattaaggtgaggggagtaaagccatgttacacagatacaaaaaacattcagtaatcgcaatggttccctcacctcacctggccctgctgttcttccttcctcatgagaatagtatcaagcttaattagataaattctccaaagggccttggccatcctcacacctcttaggtagataaaaggcaacatttcacaactcaaagcctctcctgcatgtaaatacctctgcttagtcaacacatgtggagtctgtggcctctagaaatttctgataagacaaggtgggatgtttccacctacagcagtgttctcagtcatttttctttgccattttcttgctgagatgctaccatttccagcagctccgcttgagttgtttggcctacagtctagggaagaagtggtggttctgcacaatgcccagcactctaattccaccacctttggtttttctaatttgagacacacagattttgaaaatggatgttctaggatggtgtttttcaagctatggatcatgatgtatcagtgagttgtaaaataaagttactgggttgtgactaacatctcttaaaaataaaatggaatcggccaggtgcggtggctgatgcctgtaatcccagcacttcaggaggctgaggcggatggatcacctgaggtcaggagtttgagaccagcctgaccaacatggagaaaccctgtctctactaaaaatacaaaattagctgggcattgtggtgcatgcctgtaatcccagctacttgagaggctgaggcagaagaatcgcttgaacccaggaggtggaggttgtggtgagctgagaccgggccatagcactccagcctgggcagtaagagtgaaactccgtctcaaaaaaaaaaaacaaaaaaaaactaaagctaaaactaaataaaatggaatagagcagaatagaaaatctgaaaaggtttaagtattggtgtgtgtgtgtgtgtacttctccgaggtttattaatgtggattgcaacttaaaaaatgaaaagtttgaaagccactgatacagagccctagactgaaaaccagagacttgtatttcaggcctgtgctgcttctaactggctgcagcatctccatggcagattgtgtagttttcttttggtctcagtcttctcatttgtaagatggaaagaagggttggaccagatgatttctaaggtctttccagctctaaacttttatgtctttacgaaaccttgaatgagagaagtctttgatgtgactttgttaattttggtaatttgggtagcctttgccaaaagaccactgcggctaggcgcggtggctcatgcttgtaatctcagcactttgggaggctaaggcaggcggatctcttgagtcaggagttcgagaccagcctggccaacatggcaaagcccccatctctactaaaaatacaaaaaattagccaggtgtggtggtacacgcctgtagtctcagctactcaggatgctgaggcaagataatcgcttgaactcgcgaggcagaggttgcagtgaggtgagattctgccactgcactccagtgtgcgtgacagagcgagactccataaaaaaaaaaaaaatcactgactttaggaaagaaggtggttttagaaagactaaggtacctaatatagaaaaggaaagagtgcagatgaaccatggttccttttttgtaggaaagattgtactattttggagaacggcgaacagataaaaccaatggcactaaatatcagggagtagaaactccttctcaggtaagttttcgttttaagaaagggagcttttgtaggggagtgggttaagattgccatctgttatttggtttcattttagactcttctcctttggtgatcagtcagcagcattagggcaccctgcgacaggccttggtccctccctgatgctaagggtcatgcttcaggtgccacccacacgttggggggtctggcttctcctcagagcatcctgctttctattctatactggttattgtttacggagctcaggagttgattattttcccaaagcaggaaagtccaatacctaaggctccaggaccctgaagtttatctaaaatcaccagcctttgatttcaatgtaaaaaagatctaagtctttcacagatccttattagggcaattcaacccttgcagaacatcacaaagactgtttttgggtgactcccgtgtgtgtgtgtgtgtgtgtgtgtgtgtgtgtgtgtgtgtgtgtggtgggggaggtgtattttaaaagagaaagaaaaggggaaataaacttttcaaaaacccttttatataccagacagtactgcacttttacatatctcattgaaaacccataacacctatatgaaacatatgctgttactctgttttttcttttaaaaataatttcgttatggaaaactttaatcatatacaaaagtccagagaatcatacaatatatctccatgtagtcatcacttcgctgcaacaatcatttcagcctgcaactggccacgtttcatccatacttttcccactccactcacacccccaaccccactctccactcttgctttccccaaacctggattatttggaaggaaatttcagtcatcagatcattttatcccacaagtattttagtatgacatctaagtactcttaaaacaacaacaaaaaacccttaataacttttatcatatctgaaatattacaccttaaaaatccttaatatcaaatttctagtccatgtttgtttccaaaattgtcttaaaatctttgaaaatttagtttgtttcagtcagaattcaaacaacatccacacatttcatttggtcgctatgtctcctaagtctcttttagttcatagatttcttgccattttttattgcttgtaatttgtttactgcagaaaccagaatgtttatcgtatagcatttacaacattctagactttgctgaaccattctaagagttttacattcactatctcatttaatattctcagtaactctatgagtaggcactactatgattctcatcttataaattagaaaattgaggttcagagaaattaacttttgaaccaaggactgaaatctagatgtcagactctgaagcccatgctgtgcacagcttctcatttatattgccttttctatattgcccctcaaaccgaagtgagagtgggttgggaattctcaaatagatttggatgtggctgtaaatgagtttttctttaggtggtgggaactgaataagtactcttggccctgttataagaacactaactactgtccccgtttagtttgggcaaaagaactcagccttatccactgatacttttctcccacacccaagccaaaaacaaaaccagacaaagaacagtcatagaccctaagcgaaaaggaatgtgtggatttactgaagtgcagccctactcatgccatttccatgctcaaaatccagagtatgtccccactgccagtagcaataaactaaatgtttcaacctggcactcaagatccacagtttgacttttccaaccttttcttccactatgtgcatgcacacatcccacactctaacacatttagactgtgtgctgtttcccagcccatggacacttgattccctcgtgccatttctcatgccccttttcctagagtccctttcccttcccagcctgaagtagtctcttgctttttcagttcctaaagccctttgtgtttctcttagggatgatatcactttgcattgttctctagctatttgaagtggtgacttctgtttcccctttaaaggcaaggcccatggcttacccatctttccaccctttcctcataatatcttctttgtttgtagtgagtacctcctatgggttggttgtatgaatttctactaccagtccatgttgttttaagttgtagtagaaagaagcatgggagcaaaagcagcttgagggccctggcaggttacagcctttaggggaaggtggagaatctggtggcaggagccaaggagatgttagatagagctccttcagcaactcaccccacacgtctccccatccccatctcttctgtagtcatgcatagtttcccgaactttagtccagaactagcacaccaaaggctgcaactgaatctcttctgattgactgagaaggcaacacagggtctcagctgcacatttgagagatgtgttggcaagacctcaggacagagtgccctctgtgtctggtggtgattctcggataccatcacattctgatcctgcattgtgggccattctactgactacatctactcctaagttaagaactttcatgagccttcctcatgactggccctttctaaaggaaagtatggcagtttgttacttctatgaacatttctcaatgggtaagatagagtccatgaacttatgagtacttcttcttttttttttttttggagacagaatctgtctgtcacccagactggagtgcagtggtgcagtctcagctcactgcaacctcgacctcctgggttcaagcaattctcctgcctcagactcccaagtagctgggattacaggtgcccaccaccacgcatggctaatttttgtagctttagtagagacggggtttcaccctgttggccaggctggtctcgaacccctgacctcaagtgatctgcccacctcggcctcccaaagtgctgagattacaggtgtgagccaccagcgcagccaacttttgagttctgaaccagttgattcagtaccagagctcttcaactccttgaagatagattcaaggagagccactgtgaacagcttgccctaggaaaaggacaaggctaagggaattccggggcttccttgtgaaaacagaattggggaaatggaaagtgaagaaatcctagctgtcaggaacaagagaagaatgacaggaaacctgctactgagatatggaggtattcctcttgagttttcacatatggcattctctcatgcccaggaacctgctcttcactaaaccacacaccttcctctaactcagtcacaactaagcttctatctgcacactgctaatgctgtaactgttttgttgttggttctgattagttgccctctcaaccataagcagcctgtcaacaagacctggctccatccttgtcacttccccatagcacttaattcagtattttttccccaaggtagatagttgtgaggcagcatccctcaaaatatctagtaacataatggcatccagtaaatgtttccttaattatttactgcccttaacctttatgcaaaaaaaaaaaaaaaaaaaagggaaaactgaaaataggaatgctgacttcaggcttttcatctccacttaaagtaaggcttctgttgcttttcagaatagatatgttggatattttgcacaagtgaaacatagctacaactggaatctccctccaagaaaaacactgtttataaaaagattagttatttattcgattcatggtaagtgtttatgtaaaattgaagaattgggcaggagggccaaggttcccactctgggagggttttgctcattgttatatacacagatgatcctaacttatacctgtctttttacgtatcctcatgcataaactcctccttaggtatgcccctcctcctggaattgcccattgattgccagcccttagatgttcttcactttttcttttccatcaccaatttggaggacttcatccccttcccatctctcctgttctctttgctcttctggtcacaacccaaggtggacttttcagggcagagtgagcctctgatgagggaggaggaggtcccatgtgccttcaagactggttatttctcaaaccacctctagttgagagtttgtcttggtggaggtgtctccatatcatatcattttcttaccttctttcagaggcatatttttttctcatccccctgggctctctctttcccctctgtcctccatctgtaaccctctcactcccagccactcccataccttgtggctctcactcccagccacagtgctgggggtcaagaagagcctcctaggaggagcgcttaggtcttccctgcctgaatctacatgaaaatggaaagggttgcgagagagtggggctctatggaggtatctttcacccacctagctgttaccgagtattagcagttgtaaaaatccatataaacatcatgagagctatttgcctgcttccagaatgtaagcagagagataaagctgggatgcactgttgcccagggacgcaggcaaattggtcagtcgtacaccttcgggacttgagaaagaaagtgcagagagaaactggcctccatttccatgtccatttctccatcaccaaccttgcttcccctgcacagcttaacactcagtagaggtgggaaagcaggatgtgtctgtgtagaggggatggggtctcaccactcccactgccagagaggtagcagggaggtgatgcatctgaacccctaaaggaaacctcttataacagccagcgtgtggacctgaggtggtgccactgctgggtgttataggtgccatggtgccggggtgcttgtgtccacacagagagcctagtatttttagcctcctgagtttcgttctgcatttcactgatttctggtggacatcaatagaaagaagttctgcacctggaatgggaaagagggaactgaggcaagaaactgatttctaatgaccaatgaatatcatggtgttagtgaaaacaaaattaaatgaaaagaaaacaaacggcatatgagatgatcaatcaagaataattaatacacttgtttattagaatatttgttttaattctctacttttagttttgtgccattttaaattaaaaataatgtagagttgagatgaaagcaataaaaaattaattggagcctgagaaacaaagcctttgaggaaatgctaaggaagcgggtcatttgaattgaaaaaaaaaaagggcaaaagagcctttgtctgtaaatatatattgaataccttgggaatttttggatataacctatatttttatagagattgcatcaggaactagacttaaagtagggccaaagtaatttagaccacagtatttcttattaagaatcattatgattagaagtctgaaggaagcaacacattagcaagaaaggtgtcaagtcaccttccctaaatatagatatatctatatttattccctaaatatatatatatatattccctaaatatagatatatatatttattcactttggagacagagtcttgctctaagtctcactctggtccaggctggagtgcagtggtgcgatctcgactcacttcaacctccacctcccaggttcaagcgattctcctgcctcagcctcccaagtagctgggactacaggcatgcaccaccacaccgggctaatttttgtgtatttttagtagaaacggggtttcaccatgttgatcaagctggtcttgaactccagacctcaaaagatccacctgcctagcctcccaaagtgttaggattacagacgtgagccaccgtgcccagccattttttttccctttttaatccataatgttaattggcaagacattttgatcttcacactaaccaacctaactttttaatttcatttaggtgttggaacaggcgatggatatgatctaaaagtccaaatagtaatgaagaaaaagattgtcttttcctgcacttccttaaacagttgtcgggtaagagaaaacatgtgaatagaaaaaaatctgatgtttgttttaaggctgaatgtcaaaccagcaatgttgacttccctaaactatcacttaccataaagagattccacgatgctttctggttaccatcgtggtgtcactggatttgaatgcaaaccagagataaattaacctgtttgttcaaaacagttttttcagggtactttccagaatttatttctgttcagtgttgctttgcctttcacttttccacaaatgctgagcatgttcccaggaatgtattaaggattttaatttacatgtctggtcatttttagccatattctcctcttctcggtcattttatcttttattatatagcactgattctaaaatgttagtgtgcatgaaaaccactgagaagcttgtaaagatttacattcctaggttgtactctaaagtatgattcaggaaatctggaatgggggcaggaatctatagacttagcagtgtcccaagtgattcttctaagtcagaggttctgtgggatgaccctgtgagaaacaatgcacgagtgaatgaattggggaggaatctctttatccaaagcaaaagggacctggtagtcaatgttttgctacaatgaagaaatgcctaaaactatataccttttctgaaacaatgagaaagcttccttcatgggtctaataaccataaacttttagaattcctacccaggtctttgtctcaaattcttttattactaatcctattccctggctctctgcactgcacccactttttttggcctctcccaactgagggcattcacccaggcctgatccttggctttctgttcttagcaaatgctttattcttggttaaagaatcacccatttcccttacttaaactattatttgttcatttactgacgaggtatttctagtcgcccactgagttgtagatgcaagagctgcaacatgaacagtttccactcgaactgaaacgcagtagccagtctgaattatcaaggagctttctctgcttctgcaaatggtagcagcattctcccactcaggccttgggctttgattctctttgccttggctccctaaatccagttaggcatcaatccctgttgatgatgcctttgaaatgtttctgtgctcgccttcctttctgttctcactgccactaactgtccagaacctcatttgctcatgcctagatttctacaatcctctccttaccttttcttgattcttatataatgcaatgtatagaatcctgaaatatgcgtactgaaatattgctctcattgtgaaaagttgtaggtagagcagaagacacactgcatgcccatggtcgaagccagttaacatctttggcttaacatccttacctgtaaaataaatatcacacctcaagtgttatgggaattaaattagataatatatatatgaagttgctttgtaaactataaatcactaactaaatgttatatgtgataattatcaggcctctttgtcacataggaaatatcccacgatattcttcaaaagcctcactcttatttccttggctcttgaactcttaagatataatagccctaacatacctgagcttatttttatcagtagctcgaccagcagactccattccaaataaactgggtcatcccctttggctcttggaacacaactctaagttatttagttagttagttggttatttctttcttttcttccttccttcctttcctttttttttccttgagtcagggtcccattctgtcccaggctgtagcacagcggcgcgatcatggctcactgcagcctcaacttcctgagctcaagcagtcccccaatattttttttattttttgtagatattgggtcttgctatgttgcccaggctggtctcaaactcctgagctcaagcaacccttccacctcagcctcacaaagtgctgggattatagacatgagccacactgcctgaccttttttgttgtttttctcatttctactttgcgttattgctggtctttttccctctgtatggactagattctattttcagagctttcatgcccaattcagtttctacctcctcaatgaaattttctgcacctcctgttaactagccttcaatggtgcataagagcacacccagtcttcatcatacagattgagaattatattccattctacaattgtttctttttttcttttttcttttttttttttttgagacggagtctcgctctgtcgcccaggctgaagtgcagtggtgccatcttggctcactgcaacctccacctcccgggttcacgccagtctcctgcctcagcctccagagtagctgggactacaggcgcccgccacaatgcccggctaattttttatatttttttagtagagacgggctttcaccgtgttagccaggatggtctcgatctcctgaccttgtgatctgcccaccttgccctcccaaagtgctgggattacaggcatgagccaccaggcccggcctctgcgattgtttcttatgtgtatagctccctgaagggaccaactgagtctgcacctccttttgtgtttttcacagggcctagcatagatccttcttactgtgggtgccattatttatacgagagtgagtcaaagaaatagtatatcttcaaagtcattcattccaaaacttgaactatctttggtcactccatctgcagccggtaatggtcaagtccaaagatcccactgacaaacacaagagttctgataaaacacgatgatcgggggaccccaccctcccctctcttgggaggggcaggtgggcccaccccccaagtgttacagacccctgttgttattttttaaatttagtaaataaaagaccgtgagttaagcattgtttttagaatgtcaaggctagctttaaaattgagcttctcagcatgttctcaaaagaggccctaatgtatgaaaatcaaatgacacacattaaataacaatatttaactgattaaagtgtctaatagaaaattcaatagttttgaaaagggagacacttttgaaaagtgcctcatgataaccctcaaacatgttggcctttaaaaatcataaacaacagggtgggcatggtggctcacccctgtaatcccagcactttgggaggcccaggtaggcagatcacttgaggcctggagtttgggaccagcctgaccaatatagcaaaaccccatctctactaaaagtacaaaaactagttgggtgtggtggcatgcgcctatagtcccagctactcgggaggatgaggcacaagaatcacttgaacctgggaggcagaggttgcagtgagctgagatcacacgactgcactccagcctgggtgacagtgagactgtctcaaaaaaaaaaaaaaaaaaaaaaaatatatatatatatatatatatatgtatatatatatacacgcacacatacacacatacagacacacatacatataaacaacagtattgcaactagaaaagattattaataattatttatacatgtagtgattggtctgtgagaccaaaagtacttgataaatataggaagtcttgataagtgaaaaggaacttcattgttatcattagctaggtttatagttctaaattccatgttcattcacaggtatttcatgacactgaaacagacagggtaataattgatgtgttcaactgtccacctctgtatgatgatgtgaaagtgcaagcttcctcttcggtgagtaatcaagaaacggcctctgccactgttcttatctgaacttttgaatggttttatttaaggtttcctttactacagttcccaacaagggagatgatagatgtcatcccatagagggagggggagaaaataaatcagatctataacaatttttttaaaagaacatatgtaatttgaataatttttgttcatttgttttttctaaattgtacattttctaaatttttctaaatttttctaaatttacatgtattaattcacaaatccaaaaaatagaaaataaatacaaaaaaaataaaagccaagatgctaaaaaaccaaaggtatgttttactgcatagcagtgattacattttgttttgcatcatttttaatattacaaattgagacaggttctcactctgtcaccccagctggagtgcagtggtgtgaccatagctaactgcagcttcacctcctgggctcatgcagtcctcccacctcagcctcctgagtagctgggagcactgacttgaaagagagttaggtttgggtgactcagttgggtgaagcacagagaaggcagcacaatacaacacatgaaataaccaaagcagttttttattaattccagagagaagagggcagcacacctcgcagggctaactggaagggggagccatccaggagacctgtgctcaactgatgggtggggagcaatagcgagaacgagggagggacctgagagtggaagcctttattgggatgtaaggtgttacctgagcaggtttcctacggggaggtctaactggtggatttaatgcaagcagtcatgagttccatggagtcatgctgtgactgagaggtggtcattgatatatccacatggtccatgcagagtatgggggtctgtagggaggttatatctagctgtcccataatgaagtagtcaccaacagaaggttgtataaggcagatactgggatcagtcacattgagaaacctggaggaggtgaactggaaactgtcaagggtgactgaaccctgcttctgatatcagaaagtccaatttatatttgaaagggatgctgaggcacaaaaaaattgtaagaattcactacaaaaatacttggctatatataaggataggtccttagtagattctgtttagcactatctaaaccagattcaaatttcagcatttaaattaaatatctatcatggaaaataaactattccttgaaaattttgatagaaatagcaagagaaagcaatagcattttcttaagcctcctcctctgtgtcttgagtgtgttgttatagaatgcagagtgctacatattgaatggttataattatttgataaatatataaaggaataaaggaaggaactttgatttctttggaatgattagttcttggcatcaattttacttttaaaatattttttttttctttttaggattttcctaaatactatcacaactacccttttttcttctggtttaacacatctttaatacaaaataacaagtatgtatataatatcaacccatagaaacaacctaatcttcaatgtctatgtataagatgtaatggcaagtcttttgctggttgtcataagcttaatttatagaaaacaaaaaatcctcgagccaccattgttcattgtcttactccttttactttggctattttaaaaatacagttgttcttgagacccccggttgcagcatcctcaaggtccatgccataggactgtgttatgagctcaaaagtattataatcagatcttaagtgtggaagtaaattcctcccagagaagttcaatatgaatctgctcagtaccttcaacatgtcaggtcctcagtaggtgctgatttaccaatgacgaaccaccaccaaattttgtgctaaagtaagggaggacctagggaagcttcagctagctgaaaagctgactgacacacttatatctaagagaagttacaagacacagtaagtattaagaaatacagctaaaaaatcattaaaattgatagtctcccatttaaacatgggtttctaataactgaattgggaaaactttcttaaaaactattaattggaggctgggtgtggtggctcatgcctgtaatcctagcactttgggaggctgaggcgggcggatcacctaaggttggaagttcgagaccagcctggccaacatggtaaaaccctgtctctactaaaaatacaaaaattagccaggcgtggtggcacatgcctgtaatcccagctactcaggaggctgagccagtagaatcgcttgaacccaagaggcagattgcagtgagccgagatcgcaccactacactccagcctgggcgacagagtgagactctgtctaaagaaaaaagcaaaaaaacagaacaactattacttggatttggagattattgttcccagaaaaccttctgccatatttggaaacttatttctcagtctagaagttctccactttaagtagcatttgttctgtgctggtgaaaaactgagacttttttgtatcaaccatactcttcaatacaaaaagagaaaatatttttaaaatgcttcaggtcacagttgaggcagttgctatgattgcatgtggcatgaattggtagttatcggtacaaccagttctagtcttttcttcaaatctgagctggatctaataactccttaagtccagcaaggcaacagtaaattaaacctctggtctacacacttgcaatacatacacatttaatagattttgatagagtgaactttggattggatggaaattttttacaaatttgtttcttggatgcatacaaacaataagctttgattcctaacatgagcaaagtccctcaaatgtgagagctgggtggagcttcatttgttgctgctcctcagattgattcttggtaaaggatacagtttttttcctttgaaacaccatgttcattttggggaaggaataagttagatcacctttattttcacttttatataaatttctaaagatttctgtaatatttaaatttatatactattggtaaagctgtttttcttagttgtgaaattgttgtttagccaaaaatgccaacttctgtcttttagaacactaggcataaatgggttaaccaatttatgcctagtgttccattattggaatgctaagcatgtgggatttatttatatcctactgctcaaggtcatcgccaagggctgattgcaaaaattcaaaaaattgcaacctcaggcataaattaaaagagatatagtattttattattgggttttgatacatgtctaatcagactgatttctgtcacatatagaaatttagatactgtattaaacctagatgtcattaattccataaaaagcaacgttaaaagaatcagtagcatgtgttactgatgtgttgctgaagattaagatatttttaagtctcaccgaaaaggtagaaggagccaactgagacacaaaaaaggggctgaggttctattcatggtgagcaagtcttttttttgtttgtttcttcaagctctaacaagggtgcctactacatggcttttcagttaactccaaaataaaatgtaacaattttttttctattcttaggctttatctacaaagaaatgaattggataatcttcataaacaaaaaactggaaaatttatcaaccagaatatgcagtagagacatattttgatgagaaatgacttaagttatgttgtaactggtagctgattaagtatagttccctgcaccccttctgggaaagaattatgttctttctaaccctgccacatagttatatgttctaaatcttccttgctggtacatctatattgatatatgtatacacatgttctttataaatctattaaatatatacaga

SEQ ID NO: 2226 - DNA, 134023 bp, Homo sapiens
agggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgaggtaaggggccgcggcgggcgggcgggcctccggcgcgcggccgggcgcctccatccccgtcgcctccatcccgcgccctgggcggcggggcccgggggcctcggggctgcccggcgcgggcccggcgcggcgcaggcccggcccgtcccagcggcgacggcggggcgcggcttcagcctggccccgcgccccagccgggctgcctcccgcctccggacgcctcaacttcggcaaactttgtcccggaggccgggctcggggcccgagggggccggggcgcccgcaccttttcaggaaacggggcgcgcaggcctcgctacggccgtgacccccgctggcgttgaggacccggcaccccgcggggccgcgggtttcacgcggggggacgggcggctcaggggctgcgtggccgagcgcgctgcccgggccggccgggggggcccgggcgttattggaaagttggtcctgagtcattccgcctcagaggcgcctccgaccgcttggcgggcggcgcgggggtccgggtatgggcagagggcgcgaatccccctcgcgcggccgccgagggccggcgactcccggggcaccgggcggctcctggccgcgggctctgcgtcttccccgcgggcgccaggcggctctcggcgggctggccggttccacgccgccagccagccccgtgtggggacttcggtctagtatttggacccgaggagataattctgtgtggaaaattctctcccttcggttggaaacagtaacaaactggaaacggatgaggtgttatggacgtgcttggaaatgcaagaaaccttcagattacgagctgttgacgggaccagttgtatttcacgtttttcgaattaagctcagaatcagttttcagaatgacatgtgatgcgtggtgcgtggtgtgtgtgcctgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccagggagaattccagctttttttttttttttttttttttttttttgagacattcatgtgaatttctctgcgaggggaaagaagaccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagaagcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgttatgtgtgcttgtgtaaaatttattattcataattaaaatacaaaatggctttctcatttgagaaagcctttattgactaagttctgcacaacactattccaggaaagggggtggggagacagaccaccctagggagaaggcagagttttttactattaagcataataccttttttttttttctttcggtgaagcttattgtcggcctgtacagatgacttggagtaggctggcaggtagtgggatgtcataaatgttgatgcctgttggtttctatcaactttaggaatcaggttggaatcgatgctgcattctgtattcctcgagataagtggattgttaattgggacttgggagtctttttctcatttaattaatattcagttaatgtgccctgagttctcataatgttctggttaccgtgctgggaagagtgagacacagcacccatctgctagggtgtgatttgcagggatataggccatcttggcccctgtgcacagtgaagggacatgccagaaaccagcagatacttgactgagacagaccaggacaggagcttgtggcaggaaggataaggaaaaatgcaaatctaccatcctgccctcagggtgctaacccttcgggggagaatactttctcccaccaggaagaaaccagaaagtaaaaatgtaggatgaaatgaattagtggattgtgtagaattctggaagcgtggtgggaatccaccataagggaaagagaaagtcttctgggaagcggcgttgagttgaggcccagtgtcaggaaagctctggtatagtggggccatctggtccctcttacagggccccctcccactttgttttggtaagatgggatctgacggcttgccatcctgtcactccttgccagtagatgcagtgctggccatgctgctggtcattgggtttccagttgggaagttgcatgtgctggcctttggctcttgccaggcagggccttttgtgactgggagctcatgtgggtcatgcatactgtactgtgaagggcatggtctgtggaggggaacagagcagcaggccctaacctgggtggcaccactttgctgtccctaccatttttcattgcaggttgaaagtctccaaagtggcaggggaaggggtgtaaatgttaaacagccccttcctagcctggcatgcgcacctgtggtcccagttactccagaggatgaagtgggaggatcattctagtctgggtaacacagtgagatccctggctctaaaataaatttatttatttattttattttatttgaaacaggggctcactctgttgcccacgctggagtgcagtggcccgatctcggcttgctgcaacctccgcctcctgggttcaaatgagtctcctacctcagcctcccgagtagctgggattacaggcgcctgccaccacgcttggctattttttttttttttttttgagacagagtctcactctgtcacccagactgaagtgcagtggcgcgatctcagctcactgcaacctccacctcctggattcaggtgattctcctgcctcagcctcctgagtagctggggaccacaggtgtgtgccaacatacctggctaatttttgtatttttagtagagatggggtttcaccatcttggccaggctggtctcaaactccagacgtcaagtgatccacctgcctcggcctcccaaagtgctgggattacaggtgtgagccactgtgcccagccttcccagctgatttttgtattttttagtagagacagggtttcgccatgttggccagactggtcttgaactcctgacctcaggtgatccacctcagcctcccaaagtgctgggactacaggtgtgtagtcccaccacactcggcctatttgttttttttgagatggagtcttgctctgttgcccaggctggagtgcagtggtgcaatcttggctcactgcagcctctgcctcctgggctcaagcaatgctcctgccttagcctcctaagtagctgggactacaggtgcttgcccccattcccagctaattttgtatttttagtagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattctcaagaactgaaaaattgggggccctacatttcatttcacaatttacttttttactacgatttgttccatgctgatttcgagcattaaaaaaaaaaaaaaattaaatggaggctatttggtggtaacttctcatgaggccattctaccaagaaagatatggcgacctgctgcttggacattctgatttcctttccagctgaaacactgattctgtggcagaacccaaaagcgtatttattggaaacttgatttctttaagtggaaagaaaagctaaattgattaaccaagtggggtaatataatctgtaaggcaacagtagcatcaaagtggtgaaatgtgaatctccaggagtcatgagaattgtaatgaaggtttcctgagattaattttgtgttctggaaggttaatgcccgttaggaggcctgcgtacacaaggtaatgaggtgctcgttaggccttccctccttccaccaagggccaggcacatggtaagctctgggtcagtgtttgtgtccagattctgcaagccggggagacaggagggatgtgccagatgcccacagtggttccatgtgtttggaatgtgtgtcggcacttgggtgtgccttgtagctgcctcctttaacggtgtgttcctggaggtcaggcttccatcctcccgttctgataatgcttagctccaggatttgttgcattatgggggttctttgatggaaagttttatttgacaatgtaattttcttggatgcttttaatgacttaaaagctggaagaacaggaaaactagttctcttgagctctttcatgtccagtaattcccagaaattataactttatgctggaaattaaacctgctatttgaaaccttattacagggtgaattaagagtttaggtttcagaggcttttctgtgtgactttccccttagtgggagggggtttggtatgcccattaagttttatcttaaaatttaatgtgaattttacattgtactcagtaacgtggctgattgttttaatataaacttacttcgttccctaaatctttcaaaactgttgattctccaaaagatgtattgtgtttctggaatcccactgtgtatccctggagctgtccaccccacagctggagaagtgtggcatggtggagggtaccaactttgaggatctgaattccagtctgccctctgtatttagtggtagaatgaccttgggcaggctgcttggccccgctgaattgatgtccctatctataaaatggggctactagcaccagggacatcacttgcttattatgagtaagatggatgggaaagcattgtgcaaatgttaattttcatagtattaggggattgagatgtaacagagtaagaatgttaagatcttacaatgtaaatatcagatcttgttagttagggaccacagaagttttctagttgaggtctcttattttatgtgggaggcagctgaggctctcagtgtttaggtaagtaattctcccaaggcaaataatgacaaagcaagggctcttcacgcaggataggtttttccctgcatttttcctgttcccaacgtttgctcctgggaagatgcttggcctttttttttttttttttttttttttttgaggtggagttttgctcttgcccaggctggagtgcagtggcacgatctcgactcactgcaacctccgccccctgggttcaagctattctcctgccccagcctcctgagtagctgggattacaggcacccgccacctcgcctggctaatttttgtatttttagtagaaacagggtttcaccacgttggccaggctggtcttgaactcctgacttcaggtgatctgcccgcctcggcctcccaaagtgctgggattacaggcgtgaggtactgggcccctctgatgcttggcttctgattccagctagggtcaattgagaattattgaatcacccacactttctttgagaactttctaagtgctaggggctatgctcgttgctaaagctaaaaagtcagataggatgccgtctgatctctgttttcaaggagcttccatgtgatgaatgagccagaagaataatttcattatggcaccatgtagtaggtgccacaacagtggaacagaggctctggtgcattgtggaggcgctgtgcagtttcaacctgggttaggaggaggcgtttcccaaggaggtaactcttagggaagctagcagcaggagtggggaagcctgggctggcagggagtcgcctggcagagggcccgtgagtcggaaggggttctcctgtggctgtccttcaggggagagggtacaggaaaaggcacccggccacttctgggtgctgcctttgtgacagcctaacttctgaggcaggaattctccccattttgcagatgaggaaaaggaagagcaacaggcctgttggaccccagagttcatggtttcaccacagctgaattacagtgcagttttagattttcttcagattctaaacttcttagttttgctttcagagtagacttagttttgctgctgtagagtgctttttaaacaaattgtgtatttttcatgcagcctttcccttccatccaacatctgttttgcctatatggctgatactctaggccgcactccgttccatctctggcgtaagttcctttcttacagcagcctcctcggattcactctcctttgacacatttggatgggaggttctttacgcagtggctcagatgcttcttacagcttgctgagtaacagtccctaacctgatttgctaatgtgttttctttctcctttctctcttaatttacatttaaactggtagtctagtaataatgatagtatttagtcattgtgtcttacagggttttacaaacattagcttgttagtgatgaacaagtccccaaggcctggtcactctgcagagagcataatggttgcaggctagtacctattcatcttgaatttaattataactgcagattgcctgtggaaatatgagttaaaggcatggaagcccttaccactgttagcagggaaatgatgtttggctattttggagaatactttagctcttctgtgagaaccactgtcaaggttttgaacgtgcaaccaggaggggtcagtggtggctgagcagagatgtaggggcttgtttcatggccatttgtacctgctccaggaagggctgtgaataacggaatgcagccagacactgaggccactaggtcaggtccttgggatgacagagggtagatttctttgttcttagacctaagttggcccttgttgggtggaggtggtggcgtgagagccttccctgccttctccaggttgaaggatatttctgtgcatctgggataggtctctagggttgagacgacaagcttctcaagggttggctcacttcattctttctatttctgcagtctggtctatgatgtacacagtaaaaaggagatcagtttatgtatggaaggaattagacctgctttgaattctggtctgtccttcagctaactatgctgttaaattactcttcctttctaagcctcagttttctcatctatgcaaaggtaactgtagagttcacagtcacgtggaaaagcctctgaaacctaaattctccctctggagatggatggtggtgatggtcgcacaacattatgaatgtatttaataccactggactatacacttaaaatgattacaatgataaattttatgtgtaatttaccataataaaaaagtaattgtgagacttaaaagtgagcctgggctgggtgcggaggttcatgcttgtaatcccagcacattgggaagccgaggtgggtggatcacctgaggtcatgagttcgagaccagcctgaacagcatagtgaaaacccatctcacctaaaaatacaaaattagccgggcgtggtggcacatgcctgtaattccagctacttgggatgttgaagcaggataattgcttgaacccgggaggcagaggttgcagtgagccaagatcgtgccattgcactccaccctgggcaacaagagtaaaactgtctaaaaaaaaaacgagcctgtgccaggtgcagtggctcatacctatagtcccagcactttgagaggatgaggcggggggatcgcttgaatccaggagttctcaaccaacctgggcaacatagtgttataagaccttgtctctacaaaaaatttaaaaattagctgggtctggtggcgtgctcctgtagtcccatctaactactcaggaggctgatgcgggaggagtgcttgagcccaggaggtcgaggctacagtgaggtgttactgtgtcaccatacttccgcactttagcctgggtgactcagtgagatcctgtctcaaaacaagaacaagaaaaatcagagcatgtgagagaatataagaacctaatatttcagaagtgatcatttctcttcccctttcctttcctgagtggtttgataaagggaatgacttattagcaatgtggatgacaggctgtcttggaagtatggcctgtccctggaagaaataccggtgggagtagaaggacattattggactgcaaataaattatttataaaaagggtaaaatgtctagaaactgaaatcacagtatatttgcacaaaaggaacatctatagatatctccctttttaaaaagcaattttaacatatgaatttttatatatttaaattcgtattttagcacttttttttctgttatttagcaataataatattcttcaatttgggctgggcgtggtggctcacgcctgtaatcccaacactttgggtggctgaggtgggcgaatcacttgaggtcaggagttcgagaccagcctggccaacatggtaaaaccccatctctactaaaccaaaaaaaaaaaaaaaaaattagctgggtgtggtggcacatgcctgtagtcccagcaacctgggaggctgaggcaggagaatcgcttgaattcgggaggtggaggttgcagtgagccgagatggcgctactgcactgcagcctgggtgacagtgagactgtctcaaacaacaacaaaaacaacaacaacacttcgatttattcaggcctctgttcacattttacctcttcaaaggggtcttctgaacaccctaattaaacagcccatgctgttgctgtggtcacttgccttgctttttttttttttccatagcagaaaatggttttcctttcctttttcttttttttttttttgagatggagtctcccagtcacccaggctggagtgcagtggtgtgatcttggctcactgcaacctatgcgtcccaggttcaagccattctcatgcctcagcctcccgagtagctgggattacaggtatgcaccaccccacctggctaatttttgtatttttttagtagagacagggtttcaccattgttgaccaggctggtctcgaactcctgtgctcaagggatctgcccgcctcagcctcccaaagtgctgggattacaggtgtgagcccccacacccggcctgcagagaatgtatttctattaccttaacctgtgtactaggagtgtgcctggcatatggtaggttctcaagtatttgcataaatgaaccagtatattatagcccaatgttttattgaggcaaaattcacataacatacaattaagcattttaagtgtgcagctcagccgtatttagtgtattcacaatgttctgcaaccaccagctctctctagtttaaaaatcaggccaggcatggtagcccgcacctgtaatttcagcattttgggaggctggggtgggaggatcacttgagtccagtagtttgagaccagcctgggcaacagaggaagactccatctcaacaaaaataaagaattagcttggttgggtgtggtgtctcacgcctgtaatcccagcactttgggaggctgaggcgggcggatcatgaggtcaagagatcaagaccatcctggccaacatggtgaaaccccgtctctactaaaaatagaaaaattagctgggcgtggtggcgcatgcctctagtcccagctactcaggaggctgaggcaggagaatcacttgagcccaggaggcaaaagttgcagtgagctgagatcacgccactgcactccagtctgggagacagagcaagactccatctcaaaacaaaacaaaacaaaacaaaactgggcacagtggcttgagcctgtatgtagtcccacctactccagaggctgaggcaggaggatcgcttgagcccaggaattcgaggctgcagtgacctatgatcacaccactgcactccagcctgaaggacagatggagaacctatctcttaaaaaagaaaaacaacttttcatccccctttacccattaagtaatcactcccattccccaatcctcccatcccttgataacctctaatctgcttttggtctctgtggatttgcctattttagatatagcatctaggaatcatataacttgttttttgtatctggctgctttcacttagcatgatgtttttgaggtacatccaaattgtagcatgtgccagtatttgttcctttttattgctgaatcataatccattgtatgtacatacatgccacaatctgtctattcatttgttcatgggcatttggattattttcactgactattaagaataatgctgctataaacatttgtgtacaagtttctgtgtaggtatgtttttatttcacttgggtatatacctaggagtggaattgctggtcatacggtaatatcgtgtttaacttattcccaccagcagtgttccaatttcaggacatctttgctaaatttattttttttgttttgtttctttttcatgtcatatgggtaatgtgccgacgtcataacaaggtttcagagtggcacctctcacaccttcatttgaatacccaatcacacttatgaactacaaaaggatatatgtgtgtgtgtgtgtgtgtgtgtgtgtgtggtatgtgtatatgtatgtatatatttttgtttaaagctattctagttaaagtggtatctcgtggtttgggtttgtattttcttgatgagcaaagatattgaatgtcttttcatgtgactcttggccatttgtgtatttttggagggaagacaatgtttgttgagttctttatatattctgaatgttaaactttttttttttcttcttttttttgagaccgagtctccttctgttgcccaggctggagtgcagtggtgcagtggcatgatcttggctcactgcaatctccgcctcctgggttccagcaattctcatgcctcagtctcctgagtaactgggactacaggcacacgccaccatgcctggctaatttttgtatttttagtagagatggggttttgccatgttgcacaggctggtctagaacccctggcctcaagtgatccacccacctcagcctcccaaagtgttgggattataggtgtgagccactgcactcagcctcttctgagttttattgttttagtttttacctttaggtttttgatccatttcagttaattcttgtatatggaatgagataggagtcccaattcattctttgtatgttcttatttagttttcccagcaccatttattgaaaacactattctttccctattgaatcgtcttggcacccttgttaaaaataaattggccatagatgtttgcatttatttctggactctcagttctattctgttgctctgtaagtctgttacatcagtaccacactatattagtctgttctcatgctgctaataaagacatacctgagacagggtaatttataaagaaaaagaggtttaatggactcattgtttcacatggctggggaggcctcacaatcatggtgaaaggcaaagaaggaggaaaggtatgtctcacatggcagcaggcaagagagtctgtgcaggggaactgtgctttataaaaccatcagatcttgtgagacttactatcatgagaacagcacccccacgattcagttacctccccctgggttccttcccataacatgtggggattatatgagctacaattcaatatgagatttggatggggacacagccaaaccatatcacacactgttttgattactgaagctttgtagtaagttttgaagtagtaagtttgggaagtatgagtctcccaactttttcattttctatattgttttgactatttggggccagttgcaactttatatgaatttgaatatcacctttttcatttctgcaaaaaaggtcattggaattttaatagggaggggattgattctgtagattgctttggggggttgcaatcttaacagtattgtcctccaatccatgaacgtgagatgtcttttcttttcttttttttttttttttcgagagggagtctcgctctgttccccaggctggagtgtagtggcacagtctcggctcactgcaacctccgcctcccgggttcatgccattctcctgcctcagcctcccgagtagctgggactacaggcacctgccaccatgcctggctaattttttgtattttttgtagagacggggtttaactgtgttagccaggatggtttcaatctcctgatctcgtgatccacccacctcggcctcccaaagtgctgggattacaggtatgagccaccgcgcccagctgaacttgggatgtcttttcattcaattatgtctcctttaatttctttaagcaatattttgtagtgttagtgtacaaatcattcatctctttggataaatttatttctgggtgctttatttttgtgggttctattgtaaatgaaattattttcttacctttctttttgtattgctcattgctggtatatagaaacaactgatttttgtatgttggtcttatgccctacaaccttgttgaatttattacctctagtagttattttgtgggttctgtgggatttctttatacagaatcatgtcacctgcatatataatttacctcttctttctaatttgaatgccttttatttctttttcttgcctaattgctctggctaagacatttagtaaaattttgaataggagtgatgaaagtgagcatcctcatattgttcctgatcttaggggaagcttttcaccattgattatgaagttagctgtgttttctttctttcctttttttttttgtttttgacacagggtcttgctctgtcacccatgctggagtgcagtagtgcaatcatggctgacttcaacctctgcctcccaggctcaagcgatcctctcacctcagcctcctgagtaggtgggaccaaaggcacatgccacaatgccctgctgtttttttttattttttatttttggtagagatgggtttcgccatgttgcccaggctagtcccaaactcctgagcagtcagcccaccttggcctcccaaagtgctgggattacaggtgcgagccactgtgcctggactttttttttttttttttttttttttttatcagaccaggtctcactcttttgcccaggctggagtacagtgatgtgatcatagctcactgcagtcttgaactcccaggctcaagcagtgctccttctttagcctccccggtagctgggactactataggtgcaagctgccacaccctgctaattttttaatttttgtggagacagggtcttgctgtgttgcccaggttggtctcaaattcctcaccttgagcagttctcctgccttagcctcccaggtagctgggattacaggtgtgcaccaatatgcccagttaattgattttttttttttttttttttttagtgatggggtcttgctgtgttgcctaggctgatctcaaactcctggcctcaagcagacctcctgcctcagactcccaaaatgctgggattacaggtgtgaaccactgtgcctggccactgactttttttttttaatggaaggttgttgagttttgtcaaatgctttttgtgcatcttctgagatgatcatatttttttcattgttctagtaatgtagtgtattgtattgattttgttttgtatgttgaatcacccttgcattcctgggataaatctcactttgtcatggtatataatccttttaatgtgttgttagattgagtttgctactattttgttgaagatttttgtgtctatgttcattaggaatattagtctgtagttttcttttttttttcatttttgagacaaagtcttcctttgtcacccaggctggagtgcagtggtgcgatctcgggtcactgcaacctcagcctccccagtagctgggattacaggcatgcaccatcatgcctggctaatttttgtatttttagtagcgacagggttttgccatgttggccaggctggtctcgaacacgtggtctcatgtgatccacctgccttggcctcccaaaatgctgggatttacaggcatgagccactgcaccctgcctgtagttttctttccttgtgatatttttgacttcggtatctgggaaccaatctttttttgagacagggtcttactctgttgcccaggttggagtgtagtggtacgatcttggctcactgcagccttggcctcctgtgctcaagtggtcctcccacccagctgcctgagtagctggtactacaggcacttgccaccacacccagcaagttttgttcattttttttgtacagatgaggtctcactgtgttgcccaggctggtcttcgactccaggcctcaagtgatcctcttgcctcagcctcccaaagtgctgggattacaggtgtgagccactgctcccagcccccagttgtattttgactgtgcatcatgtttcttcagaattttgaaacctgccctctcctaattgagaaaattctaagagggtttccaagcagacaaccctaacatctctggctgggatgatgatgattgtaccatgtacttcccctcttctcaacacagacacattcatgttgtagtgccagctgtaagcataggagttgcacttaatggcttacagctggggaaaatcatggctgatagcacaccaccagtgcaggatcagggaagggaactctattcctgatgccaggacaggaaagagatgtgcttccttcatttcatgaaaaagccacagattgttccggataatggttgctgaataagaaaccaccctaaacatcagtgatttaaaacagtaatctactactacatctcatggttctgtgggctgatcaagcagggctcagctgggtgattcttctgctccatgtggccttgatggaggtaatttattggtattcatctgttggctggtccagtcatgagggtccaagagggccgtacacacatgcttggatggttggaaggccaggctcaggggatcctccctctccttgtgctctcaggtcctctgcagatggcctttctcctaaggtggttgtgcttcttacatgacaactcagaactcttagagtgagtgttctaggagaggaagtggaagctgccagtctctctctctctttcttcttttttttcttttgagatagagtctcactcttttgcccaggctgagtacagtggtaccatcatagctcactgcagcctcaaacgcctgggcagaagtgatcctcccagcccagcctcccaagcagctgggactacaggtgcatgccaccttgcatggctaatttcttagtttttaactttttgtagagacaaggtcttaactacgttgcccaggctggtcttgaactcctgggttcaaacgatcctcccaccttggcctcccaaagtgttgggattacaggcgtgagctactgtgcccagtctggagctgccagtatcttaagcctgggcttggatatcagtgtagcattattcctgccatgttctaaaaagacacagagtcctcctatatttgaggagaggggacatggaccctaactcttgatgaaaggagggtcgaagaatttgtgactgtccttgatctggtatacgcatggtggctagattccatagtgctctcagtaatatatgttagatacccatttgaaaactgttgtggattaaaatggaaatgccaactgttgtgtgttactcattttcagtgagtacattctgtgttctgaatcaataatttctaaaaaacttttggagtatacctattcataaaataattacctctataaaatgtatgtcttatcagcagccatccttgatcatgtgtttgtcaagtttttcaagtacagctttgggtccatacgttttttcttcctattactagttcattttaaaaatttgttgaaaccttcccttttattttaaataatattgtggggttttaatatttctctctgttcttaaaaaaagcttcattgagaaaatataagtaagcctatatatcctaaagttcctttcctttactctagatcattctagtaaatcccctagagacagttctggctgtttatatataaaagtgtggtataatttgacagtgtgtgcagaggtgtgtatggatgtgctctcacatagaaaccctgcctccccagcctgtctcagctgattgttgcaacactgagccgagcaaacatgatgaggtcacagagaagtgagggagtggttttaaataatgaaacaggaaatctctgtctttggctccagtggtgccccagtgttttgggattaatgagggaagagctatgtctgcctgtgttccatgagtgccccttgcttgtacctctatggagaaccccaacaaccctggctggaaagccacctaatcctgtgtttcccaagcataacctccctttgttcccaagtaagtctttcctagacacctgaacttctgtgcaacataggcatgaatgaggagagtgagctactgtggtgttatatatatacacacacatatatacatgatatgtatgcatgatatgtatatatgtgtgtgtgtgtgtgtgtgtgcatagttttcatccattgtttctgactcataagtcccatagcccttgttacagtcttttgttgtaatgttgggtgtcttgcctcctttcagctgcccaaggcaggactctaatctgactgtgagtcagaagacccttattccagagagggccctgcctcattccctagaggcaggaatgctgcacagagaggccaagataagtccgaacagacaggccttgctgggtttagatcatggttttttgtccagaaacatttctagatgattgtaagtcatgcctgtgtaatgaagccaccataaaaactcaaggacaggccgggcatggttgctcacgcctgtaatcccagcactttgggaggctgaggcgggcggatcacctgaggtcaggagtttgagaccagcctggtcaacatggtgaaaccccatctctactaaaaatacaaaaattagccgggtgtggtgtcgggtgcctgtaatcccagctacttgggaggctgaggcaggagaattgcttgaacccgggaggtggaggttgcagtgagccgagttgcaccattgcattcccacctgggtgacacagcaagactgtctcaaaaacaaacaaacaaacactcaaggacagcgttcaagagcttccaaatggcggaacacgtggaggtttctgaggatggcccgagggagggcatggaggctcccgcctggcctcatacctcgccctttgcgtcccttcatctgtgtcttctgcagtatcctctacgatataccggtaactgtaagtacatatttccctgagtcctgtgagccactctggcaaattaatcgaatccaaagagggcttgtgggaaccccaacttgaagctggtgggtcagaagttctagaggcctggacttgcgactagtgtctgaagtggggatggggggtggacagccttggcgactgaaccgccaacagctttgttcacgcaattcttctgcattggcgattgttgtcaggttgtgagagcaggggaaaaacacaggttgagagagtttttccccaaacagcccctggtcgatgccccggaatgactggctgctgcatggaattgcagaggcctgagtgcctctgcttctaccgtgattcctgaggccaagacctctggtctgcatggtctgaagtctcttacgaaggtaaaatgttatgtatatattttgaataagggtacctgttcctcattctgtccttttgaattccaaaagtgtgttggcctgtgagatagcataagggacagaatcattgctctcgtgagcctttgggcttgcttccttaggcactacgtactttctcattccccattgccttcaggattctttctgtcagaatgtagtggctgtggcctgggggtgaccagcataggggccaaagaagggtaatgagtcttgaggcctacagagggtagtaggcaaggcgggagggcaagggccagggggcagcatcattcacacagttgaaaacgtgcccttggcctgtctcctctctgtgttctgcatcttagaaaatagatattgtcttgtgttaagatgaatcaatatagttacccctttttatattgtcttaagcttcttaggaactgctttgtattttagtcactcaggcttggagtgaaacatgtaatgtgtagttcaacctgaaaaaattggtctgagaggcgtcttcatagagtccccaattctatatatgatgaggtctcatcaagctttgacattctgctcttttacgtgtaacactactaatgtaaatgtttctggattgtaaagaatggtgggaagcgtagagattatctgttggtaagccagaggcaggaggaagaggaggaggaggaggagatagtggcgtccctcctgcagaaaccccgcagtggaaggacaagattgcaggaggagttagagaccagtggtctagtccccatctgtctttgtgaccttaggcaaatcattgaatctctttgaaagccttgtctccttgcatggcatatggagattatagttgctgtgaaaataaaataatcagtttttaaaaatccataaaaatgaaaaatggtatttaaggttgaaggcacttgtatttctttttctttcttttttttttttttgagatgtagttttgctcttgtcacccaggctggaggtgcagtggcgtgatcttggctcaccgcaacctccgccacccaggttcaagcgattctcccgcctcagcttcccgagtagctgggattacaggtttgcaccaccacgcctggctaagtttgtatttttagtagagacagggtttcaccatgttggtcaggctggtctccaactcctgacctcaggtgatctacctgcctcggcctctcagagtgctgggattacaggtgtgagccaccacgcccagcctaggcactcgtatttcttagtcgggaaagagaggacaggatatgtccaccacacattcaccagttcagcatgtattaactactgtgtgcctgactaagcttaggtactcagtgtattttcatgtaaagaaaaacaacatttaaaacatttaagtgagcactgaccaaatctagcttagttcagaaaaccctttttttttttttgagactgggtcttgctctgttgcccaggttggagtgcagtggtgcgatcacagctcactgtagcctcgacctctcagtctcaagtgatcctcactttctaagtttccaacattttttgggccaggtacggtagctcacacctgcaatcccagcactttgggaggcaaaggtgagcagattgcttgagttcaggagtttgagaccagcctgggctttatggagacctcatctctataaaacaaatataaaaactagccaggtgtggtggcgtgtgccattagttccagctcctcaggaggctgaggtaggaggacagcttgaatctgggaggcagaggttgtggtgagctgagatcgcaccactgcactccagtctgggcgacagagcgagaccctgtctcaaaaacaaaattttttttgtagagatggggcctctatgttgcccaggctggtctcaaattcctaggttcaggtgatcctcctgattcggcctcccaaatggccgggattataggcatgaccactgtacccggcctcagcagacctttgtaaagcacttcatgggtgccagtcctgctgttacagtgctaggtaaatgcataaaaatgctccatgaggcattctgtgttctcaggaaattcagactgccagtttcagtctggaacgtgacactttatgaaggaggcaatagaacaaaaaaaggacaaattacaggattagtaattatcaaaagctaataccgaggtcagaataggactcttgttcagtttacatgaggaatttaaccaaatgagcttctgcagagaaccagcattagggtggtgaccaggctggggtacatacatgtcatatcagaagtgacctgagactgggtgtgagaagcagtggctgatttggactactgaaagcagaattaagagtctggtggcattggggggagattagtgctgtggaagtcctgctcagagtctttctcatgatgggtacatttgggaggagcttagcagacatcagaggacctgcagagagttgacacagcgggaggaaccagctgcactaccactcatgttcttttccatcttagcatctcgtgagcataattcagaatacacagtttgattaagtatgtgcagattccattcagttcatgaattcattcccacagtgtagcctagcccaagtgttagcacttctttacttgtttttgttgttgttgttgtttgtttttttgagacggagtttcactctgtcgcccaggctggagtgcaatggtgcgatctctgctcgctgcaacctccgtctcccagattcaggcagttcttctgccccagcctcctgtgtagctgggactacaggcacatgccaccatacctggctaatttttgtatttttagtagagatggggtttcaccatgttggtcaggctggtcttgaactcttgccctcaaaggacctgcgtgccttggcatctcaagtgctggaattacaggctgagccactgctcttggccaagcacttcttttctcatagtcttctgctaagtatttccttctgtcagctgccaggcagcaatagttttcacatttgtttgtggttgtcctctagaacttggcctttagtgtggtatgtgtaggattttgttgattccaagggagggtgaaaaatgctgtgatccccagaacctgggatggctggggtatgttgtctctgaggaatttaataacattttgtggtcattgctggaatcttcctagactcctttgatggaaagtagggactccaaggggaactcctgactgggcttgcgggctgccttctcagagccctactttattagtgatttatttctcttaatgggctattagaaatgaccacaaaaactgaggcccccacccatacaatttctatcagttaagaccctggaaattcagatttagagggaatttttaaagaactcctgggagtgctgatgccctgctggactgggagcctctggtccagtggaagcagcacattccctccaggagccccagtgctttaggaatgcagtttcccaggccctgcctcagacctgccgactcacagtcagctctcagagaggctgttaggtgatcattgcgttcatttaagtgtgagaagcaccgtgcaggctttgggtgagagagtcggggttcataccttgcctctcttctttcccagctgcatgaacttgaccaagttatttggcctttctgaaccaggaccgtagcacataaagtgagtgcgatggtgcaggccccagttcctcagccacagtgctgaaaccccagagcctctgaaaatggaatgttttttcatagatttggtgccacttggcctgaacttatgtgaggctatttataatctctattccacttaatatgaatatttcattattttaccacagatggttaattaacatgtttcctgttcttttccttttttttttttttttttttgagaagactcttgctctgttgcccaggctagaatcagtggtgtgatcaaagctctctgcagccttgaacttctgatctcaagagatcttcccacctcagcctctcaagtagcgaggactacaggcttgtgccgccacacccagctgattttttaatttaaattttgtaaagaaagggttctggccgggcgcggtggctcacacctgtaatcccagcactttgggaggccaaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtaaacccggaaggcggagcttgcagtgagcggagatcgcgccacggcactcccgcctgggcgacagaacgagactccgtgtcttctcactttgttacctaggctagtctcagactcctagactcaagtgatcctcccacctcggcctcccaaagtgctgggattacagtcaagagccaccacacccggtgaattaatgtgttttcttatggttactgcctcagacttccctggagtgttatataatatataatatataaaatatgcgtacaatatttcctttctaaaattcaaaaaattctgaactctgaaacacatctggcctcggttttggataaggattgtggtgctatagatacccagcttataggtgggtcagtatatgccatgttagtgtgttggtatgtgtagaaaactcttggcagttagcaggcacccaacaaatgcagctatttttgtttgtttgttttgagacagtgtctcactctgtcacccaggctgaggtgcagtagtacaatcacagctcactgcagcctcgatttcctgggttcaagtgatccgcccatgtcagcttcccaagtagctgggaccacgagtatgagccaccacacctgcttaatttaaaaaaaatttttaattaaaaaaattttttttggtctgctgcagtggctcacatctgtaatcccagcgctttgggaggccgaggcgggcagatcacaaggtcaggagatggagaccatcctggctaacacagtgaaaccccgtctactaaaaatacaaaaaattagccgggcgtggtggcgggcgcctgtagtcccagctactcaggaggctgaggcaggagaatggcgtgaacccgggaggcggagcttgcagtgagccgagatcatgccactgcactccagcctgggcgacagagcgagactccatctcaaaaaaaaaaaaaaattttttttttttgagacggagtctcactatgttgcccattctggtcttgaactcctagtggtcgtcccaccttggcctcccaaagtgctgggattgcaggcatgagccattgcacctggactcattttttttttttttttttgagatggagtctctctctgtcgcccaggctggagtgcagtggcgcaatcttggctcactgcaacctccgcctcccgggttcacgccattctcctgcctcagcctcccgagtagttgggactgcaggcgcccgccaccatgcctggctaattttttgtatttttagtagagatggggtttcactatgttagccaggatggtctcaatctcctgacctcgtgatctgcccgcctcggcctcccaaagtgctgggattacaggcgtgagccaccacgcccagccaactgtttaaagacatttcaagccaagagcagaagttgtgttagaaggtggctgtattagtccaatttcacgctgctatgaaaaaatacctgaggctgggcgcggtggctcacgcctgtaatcccagcactttgggaggtcgaggtgggaggatcatgaggtcaggagttcaagaccagcctggccaagatggtgaaactccatctctactaaaaatacaaaaaaattagccgggtgtgtggcgggcgcctgtaatcccagctactcaggaggctgaggcaggagaattgcttgaacttgggaggcggaagtttcagtgagccgagatcgtgccactgcactctagcctgggcaaccgagcaagactctgtctcaaaaaaaagaaatactcgagactgagtaatttattaatataaagaaaagaggtttaattgactcacagttcagcatggctggggaggcctcaggaaacttacaatcatggtggaaggggaagcaaacacatccttcacatggtggcagcaaggagaagtgcagagcaaagggggaaaagccccttgtaaaaccatcagatctcgtgagaactcactgtcacaagaacaggatggtggaaactgcccccatgattcaattacctccccccaggtccctcccatgacacatggagattatgggaactacaattcaaaatgagatttgggtagagacacagccctatcagtggcttacgctcctggcttggcctcctggcaggctttttatagagggagtgggatccttgctggttatgaaggacttgtgttccttagagttacagtcttggaatgtcagccctcagcttcttgtttttcttttcacccagatggtgcacataaggaggcagcgtgaggtggggtggtggctaagggcgtgagtgctggtggcaggctgcctggtctgagtgaccctgggtcttgggcagttaccttccgtgtgtctcagttcttttacctagaaataaggataatggtacttaccccctggagtgtgagatggaaagcatttagcataggtaagctcagtaaaatttagcagttttagttatctaggactataatggaggttaagttggccagaagtataattttttttttttttttaagagacagggtctcgctctgttgctttggctggactcaagctcctgggctcaactgatcctcctgcttcagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgacttaaaaaagttgggctggatatagtggctggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccaggctgagatgtgagggttctttgagcccaggaggtccatactgcagtgagccatgattgggccactgcattctagcctcagtgacagagtgagactgtttaaaaaaaaaaacaaaaaaaacttcagaggagtcatatgattgacttgtgtgtgtctacgcagactcccttttctctgtagagacttacaatcttcagttctctggagcgttcttcagattcccttgctccatgactgaccttggctaggaaaataattgggccgtttttggtgcacagcagatgaaaattatcagtatgtccctagctttccactgtgaggccgccgtagcaacagaggacagtggatgtgtgacttgtaccctttcagagggccaagaacgcaatatcctaaagcagccttttctttttttattttttgagtcagggtctcactctgttgcccaggctggaatgtaatggcatgatctcagctcacaggagcatcaacctcctgggctcaagtgatcctcccacctcagcctcccaagtagctggaactacaggtgcaagccaccacactggataatttttgtattttttgtagcgacagggttttgctatatcgcccaggctggtcttgaactcctggcctcaagtaatcatcctgccccagcatcccaaagtgctgggactacaggcatgagacatcacacctaaccctgttcttgatacctggtttttgtggtcctttttttctaaaattcatatgaattttgagttctgctgtatgatatgtaatatatatgttctaatattacaaacttctaaaaatctttctgtgcaccaaaattgatcctccaggacagaaaaaatgccagtggttcttgtctataccaccatattttgaggaacacaaggaaagattttgaccttccctggacgtagaagaatttgtattgtgattgacacatctttaatgccttaattacttgccttcagttttctttccttttggtgcttaagggagtatttgttctccatgcatatttggtaccctttggtttagataatttagataattagcaactagttttggtctcattatcagacattttactctggacaccccatcaccactcccatcatgggggagtttggaggccaggagattcactggatgcttcttttctagtgtgtgctcttcttagatgggaaggaaaaaggtaaaacctcaaaaactctgtggtaaactgatgtgggaatctgatactaaaaatgtcccaagtgatttaaagtgtgtaagaattactcacttttctgtggagagcgatgtgcataaagacagtgacaagtggaagaagatatccagatgagaccctcactgccctcggtgagtggattgcaggatgctgggagcccccttgcgtagagactcaccgctggactccaagccctctgtggcttctgctgtggctgagtcatcgctgcccaagactactgttgggttctcctccctgctggtgagcagtgaggcaccagggagcccctgcctgcagccagctcggtgattccatgcagttttacatagggaaagaatgctctacctggctacgttttcctgtgtcctgttgaaatgaagaggttagtcatgcattccctcagctagagcgtgaggcagtccttccgaagattgtccaatttagacccagactcttcaaaggaaatgtcagcatgttttgatgtcatggttcaaaacctcactgggatggtttgtgtgagtacatacctgttttacttttagtttcactagaggatgtcatttggactagttgtttttaagtgaacatttcaaacttaactaaatttgattcctgtttccttggttgtagttacatggaaagaccactgggtctgggacagtggttctcatccagagatggagttggtggggtgggggtggggtgcagtttcgtaccctagggggcattttgcagtgtctggaaaccttcagaagtggggtgggggatgccactggcattggtaagtagaacgagggatgctgtgaacaccctgcagtgctcagcatatccctacagcaaagagttttcgggttcaaaatgttagttgcgccaaggttgagaaaccgtggcttggaaattgttcattcaccatactcttcttgatttctagtgaatgtatgactgttaagattttatgttttcataaggtgaggtactttctacagaaattcagtctctttagtcattaaacagcagagggcacttggaggctagagtgcccagaagtccatcaagccagtctggataaacccttcccaacatgccataatttacatcaaaactttggttagcagaatgggaatttttgagtagataccattagaaaaataaaataattttccagctgtggttcccaagttccccaaacttatgtctttagtccaagctgccccttgagcttcagcttcggacctgcatatttatttaacagctattgagtccttggtatgtgccgggcaccctcctgtgtaccagggcatggcaggaaatgatatgggcagctccctgtagtcatgaggcctgtgttctaaggcagaccttgaagacagggaagtccatgtgctgattccagaagaatagagggggcctggcagggctggggggaggtcaagagtggagtgcttcatacagctggtctcagaggggctcattgtcccggacctgcaggacaaggaggcgttttgtccacaaaccttgagagtgagtgaatggggcatgactggggccactgggtgttattgcttgaatgacacctaacctgtctctagtgaagctcttgattcctccctacccccatccagatgctagaagactggggagcatttcttggtccctcttctctcacaatctgtcgttggtgctcacttctgcaccctgttttcccacgtccctggtccccagcccaggcaagccttctgctgatgccggtggccccaacttgtctatccacttcaccccagttttctccaggcctttctccatgctgctgtcagagagatctaaacataggtggcctcctgcccttccctgaaaaccctttacggcctctgactgcattcagtgcaccctgcattcctcctgataaggtcttgcgtctccctgctgccccagcttcagccccaggagcctgcctgcccaggaggccatcattgttccccctggacactgcctgtcctgcctgctgccttgtcctcctttctccaggggcctggggcctcagtctctccatgcctgcacctggagtcctgttgcctgtgtcctacagtttcctcctcagccatccccacagggctgtgtccctttctactagccatgtttattttcttgtggagatggggtcttgctatgctgcccaggccggtcttggtctcctggcctcaagcagtcctcttgctttggccatctttagatgataactcactcacctgtgctgcctttcacttggaggatgggtggatgattcacagggacctgccctccttcccgcagagttggggtttttgtgtaggggatttttctgtcagttattttttcctcacctttcagagtattaaaagaactaagccattagtggtgaggcatgagggcagcgaccacagctccaggggagctctcttatccctacagctggcaaatgttccaccctgtttttatggcacacagaaaggtaggcgcatagtgatgttgttagtaagcttttgaagtagagcatggtgagttagttggcctttttacgaaaaaggaaatggaaaactagcaccatggccttggcataattactccaacatgcaaatcagtactggaaggaagttgaggcagcatacctctatgctccactagtccttaagacacgtctgaaagaaatgaaattttattttgttagaggtgaaggaatgcatggatggaatgcatggtccaggtgtttataactgtgcatttatttggcggttgttttggatggacaggaagtgggaggggagggcacagagagtcactttggccacgtccctggtttgccacaggctgatactggagcattcctaagtttcgcaatggagatggatgtgaaagaagaacacactaggccaggtgcggtggctcacacctgtaatcccagcactttgggaggctgagacaggcgaatcacctgaggtcaggagtttgagactagcctggccaagatggtgaaaccccacctttactacaaatacaaaaattagccgggtgtggtggcacatgcctgtaatcttagctactcaggaggctgaggcaggagaattgcttgaacccaggaggcagaggttgaagtgagccgagattgtgccactgcactccagcctgggcaacagagcgagactccatctcaaaaaaaaaaaaaaagaaaagaagaaccatactagtcaggtgctagagggcttccaaggcagcctccaagggaaggaaatgtctgagaagttatttaagaggatttgttggaacagaaaaacttccaaattggtctagaaggtggaccctagctatagacgcattttacaggacataatgtaaatattaaaggcacattttcagtatttggggaaaatatgtcctctgagtcgaatgaccaatggctgtttctagaaaaattttagttgtagttttaatttgattgtcttgagcatggtgatagattgactttttttttttttaagacagtcttacgctgttgcccaggctgcagtgcagtggcacgatctcagctcactgcagcctccacctcttgggttcaagtgattctcctgcctcagcctcccgagcagctgggattacaggtgcgcgccatcacacccagctaatatttatttatttatttattttgagatggcgtctcgctctgtcacccaggctggagtgcagtggcgcgatccctgcttactgcagcttctgcctcccaggttcgagagattctcctgcctcagcctcccaagtagctgggactacaggtgcgtgccactacacgcggctaattttttgtatttttagtaaagactgggtttcactgtgttagccaggatggtcttaatctcctgacctcgtgatctgcctgccttggcctctcaaagtgctgggattacaggcatgagccactgtgcctggccgcacccggctaatttttgtatttttagtagagacggggtttcaccagttggccaggctggtctgaaactcctcacctcaggtgatctgcctgcttcagcctcccaaagtgctgagattacaggcgtgagccaccgcgcctggcctagagtgactttcttaaagctctgtgtctcctggaaatggaatgtatcccaaatgaggattatttttaagctttataataaaatctttcacagcatagactttttttttttttttttttttgagacggagtcttgctctgttgcccaggctggagttcaggggcgcaatctcggctcactgcaagcgccgcctcccaggttcatgctattctcctgtctgtctcctgagtagctgggaccacaggcgctcgccaccacacccggctaattttttgtatttttagtagagatggggtttcaccatgttagccaggatggtctcaatctcctgacctcgtgatctgcccgcctcggcctcctaaagtgctgggattacaggcatgagccaccgcgcttggcccacagcatagacttttaaagaccatgtaggcaagaacagatctttaaagggaaacctcagtttggcttttgaaagttcatctgattgaagttaaactgatgaaacatactccatccatgcattaccaaaaacgttggagcacggcatggcagtagtatctaaaacagattggcaaactatgggtctaagaatagtttttatgtgtttaaaggattgtaaaaataagcaaagaagaatatgtgacccatgaaacataaaatagttactgtctggctctttatgggaaaaaagtttgccaactcttggcttaaagggtcaagaatgctttaccaaaaaacaaacaaccccctcccccctacaactgtaatgtttgagcaggagttttacaagataaagaattttgatcttgaggggatttgggtgaggatggggcggtgcagtgggagagagagtatagatactgttcatcacacccagtgcagtcggctctggtgggaacatagggtgacctcagtgtgtggtgaggacagtgatcatggccccttttacaagttgaagcttagttctggagtggtggaccatcagaagcttttaagtaggagaatgtcaatgtcataaattagagttaattgtgagaaattgaaataagtattccatttttttctgagatgtgctctcctgaacttataaagtagttcttcagaagtgtttgcagtgttcacaagacactggctctgtggtatttgacatgcagatgggcccagaattcctgacttaaggctaaagatttatcttgagcttatcatgatgtgggcttatgattgttttgatcagcagctgacatctgtgaagcctcagtgatcctataaattgaggaacctgagagaatcaagagaaagacaacaattcttgctgatgtcagtaactgtatttcacctgttaaacttctgcatggaggaggtcagtgttgtctgctgtgtcagcatcagcctacctgggtgtggacgtattctttgggagatgaaacgtagaaaaggtaccccgagtccattacacattctggattcccagaaataagacatctctgagggcagaacctttacagtcacttacatcaagaaggaattcttcaggagaaagctcggtaaaggtatcttaactttgtatgtatacccagagaaaacacataaagataaaaataaaataattttcctcattatccccacaccattagcatcttggtgtatagtctttgcatcttttttcagtatgtatgcacttagatcatcttgtaggacgccagtcccatgcattatacactttgtatctcacagtggagtggaggacagcctgatccttaaggggatgccgaattgctgcatccccatgatttttgctgctttgattcttctcatgagccccgttgctgctgtctgtattagcgtccttctgagcaaacaatgggtacctttttttttttttttcttaagagagagtcttgctatgttgcctcaggcgggagtgcagtggctattcacaggtgctgtcgtactgccctggatgatagtacactgcagccatgaagtcctgggcttaagcagttttcgcctcagcctcctgagtagctgggacattaggcccgtgccgccatgcctggctcttgaccattcccacaagccacacctacaaggagctcaaggagctgtttgcgctgtaggcggttttttttttttttttttttttttggtttttgtttgtttttgtgcagaggtcagatctcttgtctcatagtgcaaaggcgatgaaggccttcattacagtctctcaatttgactctcagtttgatcggaagttgctaagatgggctgacattgtgaggaggatactgctacagcagtagtgtgtgtgtgtgtgtgtgtgtgtgtgtgtgtgtttgtacagactgtctcactctgccacccaggctggagtgcagtggtgcagtcataacttactgtaaccttgaactcgtgggctcaagtgatcctcctgcctcagcctcccgagtagctaggactgtaggcttgtgccaccatgcctggcccttttttttttttttttttttttttttttttgtacagacagggtcttgctgtgttgctaaggctggtctcaaactcctggcctcaagtggtcttcctgcttcagcctcccaaaacactggtattacaggagtgagccagagcacctggcctgaagctatatattattgttaactgcagtcatccgacagtgctatagaacactagactctgttcctgtctagctctctccccatttttcccatcctcctacccttcctaacctctagtatcctgtgtttacttttgacttctgtgagatcaactttttttagcttccacatgtattagtgagaacatgtggtgtttaactttctgtttttggcttatctcacttaatatagtgtcctccacttctatccatgttgctgtgaacgacaggatttcattcatttttatggctaaatagtagtccattttgtatagataccacattttcttcatctgttgttggacacctagattgattccctgtttggctattgtgaatagtgctacggtaaatatggggtatagatgtctctttgatgtcatgatttcctttcctttggataaattcccagtagtgggattgctggatcatatggtagttctatttgtagcttttgaggaaattccatactgctctccatagtggctgtactagtttacattcctaccaatagtgtgtaagagttgccttttctcaggccgggcgtggtggctcacgcctgtaatcccagcactttgggaggccgaggggggcggatcacgaggtcaggagatcgagaccatcttggctaacacggtgaaaccctgtctttactaaaaatacgaaaaattagccgggcacggtggcgggcgcctgtaatcccagctactcaggaggctgaggcaggagaatggcgtgaacccaggaggcggagcttgcagtgagccgagatagcgccactgcagtccggcctgggcgaaagagcgagactccgtctcaaaaaaaaaaaagttgccttttctctgcatcctggacagtatttgttattatttatttgtttatttatttagttttgaggtggagtctcgctctgtcgccaggttggagtgcaatggcacaatctcggctcaccacaatctccgcctcccaggttcaagcaattttcctgcctcagcctcccgagtagctgggattataggcatgtgccaccacgcctggctaattttgtatttttagtagagacggggtttctccatgttgatcaggctggtctcgaactcctgacctcagataatccgcccgcctcagcctcccaaagtgctgggattacaggtttgagccactgtgcctggcctgtatttttgataatagccattctaactggggtgagatgatacctcattgtggttttgttttgcatttccttgatgattagtgatactgagcattttttatgtatttggccatttgtatgtcttttgagaaatgtctgttcaggtaatccccctgccccggcttttttcttttcttttcttttcttttttttttgagacggagtctcactctgtcacccaggctggagtgcagtggtgtgatcttggctcactgcaacctccacctccaaggttcaagtgattctcctgcctcaacctcttgagtagctgggactacaggcgcacaccaccacgacctgctaatttttgtatttttaatagagatgggagtttgccatgttggccaggctggtcttgaactcctgacctcagttgatccacccgcctcggcctcccaaagtgccaggattacaggcgtgagccacccacctggccaatttgcccattttttaattggattttttttttttgctgttgagatgtgtgagttccttgtatatcaatcccctgttggatgaatagttcgcaaatactttctcccattctgtaggttggcttttcattctattgtttcctttgttttgctgaagctttttagcttgatataatcccattcatttatgtttgcttttgttgtccgtgcttttcagttactcatcaaatcttttcccagaccaatgtgatgaagcatttcccctatgttttgtagtagttttatcatttgggtcttatatttaggtctttgattcatttttagttcatttttgtataggatgagaggtggaggtctagtttctattttcactcttctgcatatggatatttaattttcacagcaccatttgttgaagagactgtcctttccccaatgaatgttcttggcgcctttgtcaaaaatcagttggctgtagatatgcaggttaattcctgggttttctattcttttccattggtctgtgtatctgtttttatagacacataccagttgttttatagaccagtaccgtgtcgttttgcttactacagctttgtagtatattttaaggtttggtagtgtgatacctccagctctgttcttcttgctcagcattgctttggctatttggggtcttttgcagtttcatacaaattttaggatattttttctatttctgtgaacaatgtcattggtattttgatggagattgctcttttaattatcttgatttctttttttcccccccaagacagggtctcacttcgttatctaggctggagtgcagtggcatgatacagctcagtgcagccttgacctcctggacttaggtgatcctcccacctcagcctcctgaatagctgggactgcaggcacatgccaccacatctggctaattttttgtacttttttttgtagagacggggttttgccatgttgcccaggctggtctcgagctcctgagctcaagcggtccacccacctcagcctcccaaagtgctgggattacaggcatacaccactgcacctggcctcttttcaatttcttgatggtgttctttgatgtacaaaagtttttaactttaaatgaagtccagtttatctactttttctttggcttattgtgcttttggtatccttttcttttcttttctttctttttctgagacagaatctcgcactgttggccaggctgtagtgcagtggcacaatcatggctcactgtagcctcgacctctagagctcaagggagcctactgccttagcctcctgagtagctagggctacaggcggtaccattatgcctggttaattttttaaattattttttgtagagacagagttttactatgttgcccgggctggtctcaaactgctgggctcaagcagttctcctgcttcagcctcctaaagtgttgggattacagatgtgagccactgttcctggcttggagtcatttctaagaaaccattgcctaatccaaggtcgtgaagatttacatctttcttctaagaattatatagttttagttcttttctgctgtgatcatgtgtgtatgtgttggttttttatttttatttttttgagactgggtcttgctgtattgccaggctggagtgcagtgcttatccatagccatgatcatagtgtactgcagccttgaacacttgggctcaagtgatctttctgccttagcttcccaggtagttaggactacagtgcataccactgtgcctggcttattgtgtgatctattttgagtcaatttttgtggtgtgagataggggtccagtttcattcttttacatgtgtatatttacattttgtagttcatttgttgaagggactacttgtattagtctgttctcatactgctataaagaaattccccagactgggtagtttttaaaggaaagaggtttaattgattcacagttctacatgtctggggaggcctcaggaaacttacaatcaaggcagacggggaagcaggcacgtcttacatggcagcaggcaagaaggagcgtgtgtgagtgcaggaaaaactaccatttataaaaccatcagatctggtgataattcactcactgtcatgagaacagcctggggacaccaccactataatccaatcacttccttcccttgacacatggggattacaattcgagatgagatttgggtggacacagagccaaaccgtattactattctttctccattgaatggtcttggtgcccttatcaaaaatgtattttccataaaaaaacaccaattgaccataaatataagggcttatttctggactctaaattctatttttttttttttaagaaacagggtctcactctgttgcccaggcaggagtgtagtgatgccatctcagttctcttcaacctccgcctcctgggctcaggtgatcctctcacctcagccccccaagtagctgggactacgagcacatgccaccaccctcgcctaatttttgtattttttgtagagatggggttttaccatgttggccaggctggtctcgaactcctgagctcaagcagtccaccctcctcagcctcccaaagtgctacgattacatgcattagctaccatacaccgattgtacaggccacaggctagccccacacaccagattttgaagattaagtgtggtttaaaaaaatgcaaaatatcctgttaataatttttgataatattacatgttgaaatgataaagtttaatgttgtgttaaataatacacagtaaattttactgacttctttttactctttaattgtagctgctaggagatttaaaattatttttgtgattctcgtatttctgttggaccagaggtattttttaatagcatgacattctgttacatggttgattatatgatgatcatatgattgtggcagtttcttgattcgattctctgttgttggacacttaggttgtttccagtcttctctgttttccacggtgctgtgatgactgacactgtggatgggtagtcatgcactcctgtgcccgctgccaggaaagagctcataaggaggacctgggaagcatttgctgcacttctgaatctagcgcatgcagactcgaccctgtgggtcgagctttggtgagaagtggttggatttggaacgtatcttgaagacgaagctgactgtctttgctgatggattggatgtatggcatgtgaggaagggggtcctttatgatctaaggaattggatggtgccatttcctgagccaggcattgccagaggcagatcagagaggaacgggtaccaagggctcagtgttggacctgttaggtttgagatgcctttttgatgctcaagtggagatgttgagttggttattggatatacaggtctgggggaattacagggaaaggggtgctggagatatatttgagaattatgaaaagctgtttgagcatcaagcaggatgggtgagacttgaccactggattttgcaacttgaaggtctttggggacttggacaagactggtgtcaggaggcatgacaagtggaagttttcaggggagaatgggatgtgtgtgttaacagcttcttgaaagagttttctctaaagtagaatgatgggggagtgggggtgctggggacacattagcacttaccgtgctctggaaggcagggtgttcaggagggaggttgacagaggagggcctgggatccagtgccagagtagagggtggaccttgcccatgggatctggagggagggcagagtagacaggcaggccttcctttcagcagtgggaggaggagaaaataccagcttgcccctttccaaaagctgagagtaagggtgacaagggggaaagaggtattataggtatgctatggagttaaaggtaaagtttgcatgaatttcgaatacaaaatgtaatacttcatatccattgagttgcttcaaagtgcttatcctcagggttctctctcctgtgcctttgggggtactttggtgaaaaagtttgagaagccacttcattattgtagtctattgttacgttgttaagtctcacccaagtgagtatttaaccttaaagagtttgagattcacttgcctattttgttatccataatagagcttttgcagctgctccaaatatccctccatttgtgcatcttaatagttgtttggcaatcaccttattctgcactgggaaggctggagaggggtggggagctgcggggtgtctggaggcagtatggcgagctcgagattcccaccctttcagagatgaggtggtggaggcaggcagggcctactaggcttctgaagcaacactcgccagggacattttagtgaccttttccccgtgttctcaaaacactttacaaatacaccatttgtctttaattctggcagggtggtttgggtgagctgggggtagtgctgttagccaaccttttacaatatttaacaatcagtagagattaaaagctgtttggcctctttcccattgatcacatagcctttttctttttgtacaattttagtatgattaaccctcccacccccattaaagttcttcagccttcttagtagaaagctctgtgaagtttgattcacccacggaagttacttcatggagtggaagcatttgagaaatcagatcttggctttcttcttgtggacagatcaggtggctgaggcctggagggagcttgatttgagatgagtagtttgtatgcctgactaagtcaagtagccacttacttcccttcacacttaatcaaatcctaactctctaactgaaactttgtaccatttgaccagtacctctcctttccccattcccccgctcccagcctccgtaaccactgttctactctacgcttcttcaccttctactttcttagattccacatataaataagaccatgtggtatccgtcacatatttcacttagcataatgccctccaggctcttctgtggccatggatgataatcatgtattgtatatttcaaaattgctaaagagtagatcttaaatgttttcatcacaagaaaaggaacttggtgaggtgatggatagattaactagtttgatttaatcatttcacaatgtatacatagatcaaaacatcccattgtatcttataaataaatacaattttttttgtcaattaaattttttaaaaattacaagaggctgaggtgaggttacagtgagctgtgatcatgccactgcactccagcctgggtgacggagcaagactctgtctctaaaaaaaaaaaaagtgaagttaaaaattaattaatttaaaaaaatcccaactcttccatcaccccagccctgcatccttctcccttcccccaagaccccctcccctgccactatgctctgattcctagagcggtgtgtccctgtcctgccactcttgctgtgcctgtggctgtccctgttccttgggtagcttccctgttactcctcaggggcttccctggccaccctctgctcgggcccttcctgagtgttacatcagcacctttcttgcccgcacccaccaccagccacagcttgtgtttgccgtgtgagccggagcacttgtttgtcacctcacggtcttcccctccatgagggcaggcacggcagtcttgctttcattcttgctttcatgcagtctacccagctgtgggcgagatgtgtgcacatcgctcagcatgtttgtagaatgaacacatgtataaactagacttgaatggagattattgttctctcctggccattaaaggtgcttcttcctgctgctcatttacatctcaggtgttaccatctctggccagtgcctgccctgttgttgtcatctaacagtcatgggaccacacctttgtgactctcagggccagaggtgtttgggaatgtggaatttttgagatttttagaacagaaatagtgaaagtaccgtatagtataggacatcctaggcagcaccatataatcaagcacattaagatttttgcagcaaaaagtatatgaatattcacactaagtgggacagtgagactatgaatagcttcacatcagatcagggcataccgccaagtgagttatgaacatgctttcagttttcagagagctttttggattttcaaattgcagagaagggattatggacctgtcttagtgagcatctgcttgtcacgcattatgcagcgtgctgaaatacaaaggaagaaaacatcacgcctgccctcccgtgtagggggtgggtggtcaccacatgcgggtggtgagcccatgctgggagggcactcccggcaggtcctgttgttctccctgtcatctccccctttcctttgcgagcgtcctctacaggtgcggtttcaggtgagccacatggggggctggcagaaggggcactgcattgtgacgcagggtcaaatgtgtccctctcagagtgtaggaggtaaccgttctggatcgcctggatcctgcccttgggtctggctgcccgggtccaaggaggaaagggccgactccaggtgatgctgcagaccaggagcgctgccctcacttcctaaccttctgcacttgggtgccggggccccctctctgcagtcacacactctgccctcttagctgggcctagagctttaaacattaactggattcaacatacgtttttctgactttttaaatataatgagtatagttttattttaatgtttttcagatgcattttgatgtaggtaggtacctttacattttaaaaatttatttgctttctgaaatgggaccagcatatatatatatatatatatatatatatatatatatatatatttttttttttttttttttttttttttttttgacaggttcttgctctgtcacccaggccagagcacagtggtgcaatcacagcgcactgcagtgcagcctcaatctcctgggctcaagcgatcccccacctcagcctcttgagtagctggggttataggcacccaccaccacacttggctaagttttaaaaaatttttttatagagacagggtctcactatgttgactaggctggtcttgaactcctgggttcaagcagatcctcctggctcagcctcccaaagtgctgagattacaggcatgaaccaccacaccctcctggtacctgcattttgaaaatgtttcattgccaagcctgcagggaagtctgccctttttttattagaaaatgaagagctaattctgaaatatgcctactaaatatgcatatctcaagcactttaaaaggatgtagggtgaaatagtctgttcctgaagcaaatatcactgtgtgttcattccattatttccgtagcttttctgtggcttttgataagttgtgtagaatgtattaagtctcatctgaaaatgtatattaaagattgttcttttaatttaaaatgatttgtccaaggtacttgacttaatgattcaagatttaatgagccgtgacacttttagtaacaccgtctcaatctttcagattttataaaagatattaaagttttcagaaagttgagaatggtcttttgtaatgtattttaagatagttaagaatagagtttatataattaagattaggatttgtattgcaaaaactcccttcaagacgcattttgggcctttatgagcgagtaatcatgacaggacagagtggcttcacccacagttttgtggttaatatttgcaagtcgtttatttaacaaggttgaaaagaggcttcctggtgtcttttataattatccttttctggggaccaacttataaagtaaaaaatacctggtggcattatctttgcttcagatgtattatgtttatggaattggaaatgtttgatttcttagtgtgtgtgtatcagtggattatgtagtttaaaatgtttgcatctgtattgcatgcataaacatgtccgtttccaagtgtggcctttaaatactcagggttttgtggccgggcacggtggctcacgcctgtaatcccagcactttgggagcccgaggcaggcagatcatgaggtcgggagttcgagaccagcctggccaatatggtgaaacccagtctctactaaaaatataaaaattagccgggtgtggtggcgtgtgcctgtaatcctagctattcgagaggctgagacaaaagaattgcttgaaccctggaggcggaggttgcagtgagccaagattgtgccactgcactccagcctggatgacagagtgagactccatctcaaataaaataaaatacaataaaataaaagactgagggttttttaaaaggtcataatagaaaaattttatgtgttttaattgtttaaatgttttcttcgggattaaaaaaacctgaatgtattctgggaaaatgttaaatggatgcaacactataagattttccacagaaatatgttattcaccgtgaagcacaatgggaaggctccattagcactttagatggtatcataactttggaaaaaccatttcaccatgcgagtatttacaaaaactgaagctgtccctgtcaggttttgacagagcttagctatataggtagtaagtgacgcagtgccaaaaccagtcttaaattacctatgttgtcaatatgcagattttctctatttagtatttaagctatgaatttaccaatctgagtaacttgaaatgcagtatcataaaaagaatcagatctaccaaactgaaaatgtgtgcgtatctaaagtagtttcttttcttgattttggttaagttaacaggagtatcttcacatctgtaatttctggtaacttaatgagaacacactgaacttttgggtcacaataaattttcccattatgtaaaatattttacacaccggttgactcattgtgaattgtgagtcgacatgattctcttcctgcggaaaacagaaacacatgctggccgggcgctgtggcttatgcctgtaatcccagcactttgggaggtgaaggcgggtggatcacctgaggtcaggagttcgagacccagcctgaccaacatggagaaaccctgtctctactaaaaatacaaaattagccgggcatggtggcacatgcctgtaattccagctactggggaggctgaggcaggagagttgcttgaacccgggaggcagaggttgcggtgagccgagatcacgccattgcactccagcctaggcaacaagagtgaaactccatctcaaaaaaaaaaaaaagaaacacatgttattgtaatgatgatttgagccaattacaggattgtgcttatgttaccacattgactaggtgctttctgtgagttgggttgttgaagagtttgaggtagacagatggcagtgggtgggaatgagcggggagcttttgttaggtttagggaatgtggtctttccaccatcatttagttgtttattttatgcataggcttattttcgttcttgtgagcattatgttgagttaatgtgttttctttgacctcaaaccttctgaaatgtttctgggtcttaaagattcaggtattatttatttcatagtagacagaatcaagtaaatgaatactttcttgggggagagtgttgataagttccatagcgacacctctccctcatgattaaaagtgctacatttgcacaaatatgtgacttatattttatattaaaattaagatcaacttttttcttgagaagttgttgaacttttagatttgggagagggggagttctcacaggaattatgaattgttttgactagtgagaagcttatttaacatttttggaaggagtaccccaaaagtaatgcatcttttggcatagtggaaacttgcagtaacgttttcttgttgttttttaattgattgggtgacctgcatctcattaagtggtgtctattggatgtttggcctttggcttgattgtgtccgcttttaaaaaataactttattgaaatcgtcacattccatacaattacctatttaaagtgtccatgtctgtggtttttagtatattcacagagttgtgcagccattgcctactttggacattctatggaaatgcggttgacaggatgtgttttctgtgtgcagtctctgtcactaagcaccatattttcattcatattgtgcatgtatgcatcggttgttccttgttaatgtcgaatattattccattgtgtggatgttccacattttatgtatttgttagtccattgatagacgtttgggttgtttctactttttggctgttgtgtgatagcgctgctgtgaacattcatgtacaggtttttgtgtggacatgtcatttctcttgggaatatacctaggttgtttgtatctgcttttgctgcttcttttacctacagttcagattcccatttatgtttgtacagacagtttgctacttgtgactggggcttgtttgacctttgttgctgacctagcgacttcttgtgtcatgtttaaagcccctgagaccctctgttgcctagagaaacaggcagaattgcagtctctttccttcctaagaccagatcacatctggtggtcatgaaatggtcttatcctgtatagatttttggtaaataagtatgtatctaagccaaataaattttgtgtgtattttatattatttttcttctctctgcttcctcttggggacatcctttgttctgtggccccagtggcacctagagtgaatatgaatgatttgtctatgttttcccttcaggcggaatgccgattacttggattttttcttgttaattttggtgactgagttgcctgtttttgaagtgaaaaatacctgcagatagtagggttgccctttagcattttaagtgtctaaatgagacctattgggatgtttccatagtttgcatcaaattcatgtaaatgcgcgttaatgatgttagctagtctgcctgagctaaattactaatttcattactactatttaataaaggggcaggatttgccatggtcattctagttaatggtaagagccctgtaggtctctcatcatatatctaagctgaattaaggttgaaaatattactgagtgccttgtggctctatttggtaacagtcatgccttacattttgagacagctaatccttttacacaccaggtgactcatgtgaattgtgagtagacacgattctcttcctgcagaaagagaatgcattcagtcagttgaaaatcaacatcatgtggtttgtaggataggtcttactcctttcttagacaaggaatctgggatccagaaggagtgagcggttggttaggaggagtcagtgccagagggaggcagcatgccctttctgctctgcccacgctgtgaggacaccgggccgtgccttcgccaggaggaggtcatgccaagtccaaagcgtcaggccgctcagagccaagcagctttgctggagcacccactggtgcacttggaaagtgatttctcctgttaaagcctcgctgccacctcaactgtaaactggagacagtaggaagccaccttcacaggcctgcggggacctggcacccgtgcaccaaaccttgctgcccttaatcagatggtcgaattgagaggcagttggaagggtcctgtggtgtgctccttctgggaccttctgccaccccttggaggcaggttgcgcccctgcccgtctcttcccaccagtggacactcccttcagccctgggccagctgtggggccctcctctgtaggcgctggctgttccaggaggcacaagagtgttggtgtgggaccttcccactgctcgagatcccccacggagagcccactcaggctacgcttgggcttctggccgtgtgggtcagcgtcacaggacggacagatcaatgggggaagagtcatcctgcagcgctgccaccactggaggctggtgagagtggcgctgccacagagaacaagccttgatccctgacttgaaagtcagagttcttctggaacttctgtggggagtgcccagagtggcacctaaatacgtctagaagcgcttgatgaaagttcctctgaggcttttaaactgcttgagtgagtctctctgaagcacggtgatggcaaaaggaaaccacctcacgctacctctttgtgccttctcttctctcctcatctcctgtaggccgtaggtgttccctgtcaggaatttacgcggaggcatgtctgctgtggccaaatgtgttcattcattcatatctcacagtaagagggaaggatgggggaggaagactgctgtatttccttaaaagtttttctgtaactcgaatccctcccacccccgtgaggtaacaacgtcttttccagttggtgtcagtgaactctgttttgggtatctacaaaagcagaaggggaggttaggatgtggctggaggaggctggttcctgggtgtaaatcctggctcttctgcttgaactgactgtgcctcagcatcctcgtctgtctggtggagccgcctcacagaggaacaagtgagttgtgcgtgtggagcaggtggctgacatgtggtgagtcctccaggaatgtggcagcagaaggaacacgttgagcaccgcagataccaccctgaccgccactgcagggcttctgtgcgggggcagctgcagagccgccgcttcaggacagcatgggagctgctggaggtcgggggagctcagggaaagggccttgctgccaggggtgggaagggagtcagtgaagacgtcctggaggagaagattccagagcctgagatgtgaagtaggttaggtagccagagacaaggcaaagaagggccattttcatcagagaacagcataacattggcagaggtctgacatgtcatttcctgttactagaattggggagtgaccagtagattctttaatttgtttattcattcgtgcagtccttcacctcacacctgttcagggtccggctgggctctggacatagggtggaagaaaaccatctgagcagaggccgcgtggactgtcacctctgtcaggggtgccagggctgccaaaggacagctgttacttatgggtggcggcgtggtgaggtcgcacaacacagagctgccctgctgtgtccatgccctggtgcctccccgtggtcaccatgtgccttgggcaaatggaggcctcaggtcccagacataggctctgtcagtggtggtggcggtggctgtacctgctccgggctgctgtgagggagggacgggctccggccacaggcgtgcaaggtccccttgcagaggacctcccgcacctgctgaggaatgtgtacagccatctggagggtgttctccccctggccctccctgtagtccagctgagtccacgtccttcagccccttttcaatgttcctttctcacagaaccttgtcctggaggtgcactcgggcccgggttcttcctcctgtgcggtgccaagccctcctccaccacgcatgatggtgtgttttccatgactcttcctcctagagcaccggtgcccgccctgacggcggttccccacagtcagattgagtatcccttatctgaaatgcttgggactagaagtgtttcagattctgatcttttcggattttggcatatttgaatatgcataattggatatcttggggatgagacttaagtgtaaacacaaaattcttttcatatacaccttatacacatagcctgaaggtaattttatgcaatattcttaaatattttgtgcatgaaacagagttttgactgtgacccgtcacgtgaggtcagttggggaattttcctcttgtggtggtatgttggtactcagaaagtttcggattttggagcagtttggatttttggattagggatgctccatttgaatattctttttatatacagcacatggtcagtgctcactaaacttagtattgcatgaatgaatgaaaaccaaaggtcatttactaagcgtgctactatttcagaagcctctttttcctgatttggttctatggtcagtggtttaatatttcaagtgctctgaccacgtaatggttgttaccacactgtgaaggtggctgggtgttcagtgattgctgcccacagaggacctggaagtgcttgctgtacttggttttctggaatggaaatcatggctcattcccaggagcccctcagcaggggctttgagtctggtgctaagcagcagatgtgcagattcccgcagggcgtacctgagcccggagagggggcgtcgtagcgcacagcgcactcgtttccgcattcccaccccgcacggccagttgtcacagccatcctccagtaaaaaacacaaaccagtcaacctctaggagacaggtaggaaatctagaagaagcctcaggtgttcacagcattttttaaagattctttaaaaatcttcgtgattggaaagactgcttcctgtgccagagagtctctctccagcgcttttgcttctgaggttggtagctttcagaaagactgcaatgcagcggttaccaaagtccttgttaatatggaaacaactcgtggtgaagccttttgctccccttcacaactgctgactgttgcctgcagtcggaaggaggagataatgaaggtaatactcctccggacctggcagtttagtgattagaacgtacgcgattctgtgaatgctgtggctggcacagcatgtcctgcagcagctctgtcaacttactgatgcagtgggcttcctgggaacgtgaagctgaagatgtctttgcagtttgtgcacgataattttgttttcatctctgtgttcagatggtggattataagaaggtaagggactttacagatcatgcatatatgtattttaaatgtttatgaatatccctaatcaaggtaaagaattatgattgaatagacctcttttgaacctaagaaataaaactttatttcttgttaatgacccttttgacgtttgaagacttatcttatttagtcttgacaaatgccctatataagtgaattattgaagatgttctttgaagagatctgctttttctttgatttgctaaacgtagttggtttcagaggtgtagatacgcatagaatatattcatttctttaacttaagcaatgacagttacattaatctggatggaacttttcgtcttaaaaaatctcagccactggctgtagatgatgaattctaatctccttagttcttattttgcctttagaagagcattttcagatgtgtggagctctgtgtttatccgtggggtgagctgggtgctacctccagctgctgctcttcgtttatcttagagggaggccaagagtcagagcggagatttattttgcaatgaattagtggccccaaacggtattaaatgcattatgggtggtaatttatatgtccaatgccaagaaatataatgttggggttaccatggcaactgcttgcattctgaaaagcttgtgaatgggttctgaaccttctggcattggaagtgagcttttccagctgagggcctgcattcgtgattagtgtaaataaattcagctttccatatgaagcacatcctttctctttgtttaccagagtagtccattgagctcagttctttctctggtgatgtctgccttggtctcttggttcctggcaacagaatatggttgagacatagttttcaacttcaggctgaggaactagcctgtgtgtgtgtgatgacctgccacctcagtccatgcactgtgtagaaggggctggctcatctgtacctcctgagggctggcaatgcatgatgtctccaaaagcacagttgcagccgcatgtgctggtgggctcctggcacagctttctatccatctgaagggcttgtttccggtaacacttgctagggctcttcctgggaggcagccctgcctgtttccagggtatcatggggattggttttggggagggaggcccaagttagaaagacccatgtttaaaatgtcaagcttgtgaaaatgataaacgagggcctattgtcttcattgccgaagatctgtttgctgtttgttagaaatatatgtagcataggccggggatggtggctcacacctgtaatcccagcactttgggagacgaaggcaggaggatcgcttgagcccaggaatctaagaccagcctgggcaaaatagcaagacctcatgtctacagaaagataaaataaaataaataaataaataaaactagtttcccttgtgcatttaaaacaatgttgacatcttgatggccagagactgaaatgtctgtgtgtgatttcaggggcctgaggtcggaaggttggagcctggtggttgctgccgaggcggcagctcctagagggcctggccagacactgggagaatgttttcatgctctgtagaattcattctctttgttaataagcattgagattatagaatttaaatgttgagcttgaggatagactggccttgaggcacacagcgggcatgctgctgtggctcacctgtaggcctcagttaagaatctttgtctaatccaatccctttattttacagatgaggaaaatgaggcccaaagaagtgatgccacttggttaaggtcccagagcaggtcagaatcagacctaggatcagaaacctggctcctggctcctggctccctactcttctaaggatcgctgtcctgacagaagaggtttgctctcagttaattgatgttgttgttgttttgctttccttttgtcagaaagaggcctgtaataacaacaggcatctaatttagactctgtaatttagaattttaaaaattcttgtcttcccttcttctggttatttatagaatttctactcagtgtgctggagtcacccataggaggggcaaagggcatgacctctgcccttaacgctgtgtgctgtgatgagagatgggtgcatagccgagcctgcaaactggaatgttgggataaattctggcttgacatctccatttctgccaggctgtggtattctgtgttcttacagagaagctgcagtgcccagcagttacccaggggtgaatctgaatcaccacctgttaaatcaaggtcatgatactgtatttactaaggcaggacaacatagtaatttaggctcaacttacaagttgcaacttattacaagtaataagaggttcggcttacaaggtttgaaatacaaattgatttttttagccagattccattgaaccctggtttttaattttccaatcttgaaagaagactgagattttactgtataactcacttagggtgacattgtgttttcctaagtattctcagtgatttctcccattctccctattcttctcacatgggactttgacagagagctgcacctgggctgggtgtgtggcctccctcacccagcagtatggcccaatggtgctatgtgactgctgagttaggtccttaaaagggtgcagtttttgcctggatgttctttttggggtacttgtttgccatccctatggtgaggaaacccatgtcgcccacacaggaggaccacacagtgagcagggcattgacataacaaggtgacttctgttttctgagtaacttccaccacagtggtgaaactgtgtccccaagctcagcaggcggaggtaaaacatttttcaaagaaaagggtaagataggctcttggtttaccacatggtgaagagaggcctctggctcttccaaactgttgcagatagagcgtggagtgctgggacttcggtcaggccaggtcctgccgcctcactgtccagctctcctgagtgctcctggtctgccttgctctctgcccagtgctgcctgctgcccgctgcccttatgtggagtgaccttctgtctcccagccccagccatgggtcccgttgcccagaatacaagagcctttcttggcttagaactttaattcaaaaccctcagttcttagagggtttgttttccctttttttttggcctgggattttgagaatatctaatagtgctgggcagttttatcattcatcatcatgggtagtttggtttattacaacttgcagcttcatatcttgtaaaacaaattcatttcttgctttcagatttgcttatctaaaagttttgttcataatagtaacttagcacaaggcttctaatatatgagttgatgaaaagcacctcctgtatcacctttaataaggataattttgaagtgtaatttaatgcctggaagccagttggtactgaggtttaattttgtacttgggaaagaagtgtgagaagaaaagtatccttttttccttaaatttatttttcttagttgacatataaaattgtatatatatttatcatgtacaacatgatattttgaagtatatatattatggaatggttaagtctagcaaattagcaagtgtaaagataaactcacagttatctttttttgtggtgagaacactttacattttttctttcttttaaacataaaatctttcagaaaagacgtctactttctcagcatttttcaagaagaaaagtatctttttaacaaatacattttctaagccctggtctgcaacccactccattcagttaatatttatcaagcactggccgggcgtggtggctcacacctgtaatcccagcactttgggaggccgaggcaggtggatcacctgaggtcaggagttcgagaccagcctggtcaacatggtaaaaccccgtctctactaaaaatacaaatatgagccgggcatggtggcaggcacctgtaatcccagctacttgggaggctgaggcagaattgcttgaacccgggaggtggaggttgcagtgagccaagattatgtcattgcattccagcctgggcaataagagtgaaactctgtcctcccaccaaaaaatatatatatttatcaagcactacctacacacacacccactctctcttatacacacacaaacacactaatagacatagcagtaatatatattaagcatgaatacagcaagaagtttggtaccctagaattagaacgggtttttttttcgtatataatctacaaaatgagatgttgaattgatgtttaatactaagctacttcttaagcatttgatttttcttactgcatttacctatgtttataattttaaaatctgagaattatagaaaatacgtaatttctacttatctttcagattatagcttaaatgtcctctcctggggtgggggaggtccccatatccacataaatgggtgtgacctccatgtgcactgtgcacttccctttggtacttttcgtctcacacacatgcacaccctgcacagacacacacactcttattgctggtgttctgtcttcttgcctgtggactgtcagctctgtgaaggggaggcttctgtctttcttgtccctctcccttctgtggcactcagtacatgttgggtgaatgaatgaatactggacacagacgctttccttgaaggtggttggatgatctaccctttccttataggactttttcagatgttttcaaattcaaccaagaaatcttttttttctattactaagttactgtttttccaaattattgaatatttctattttctcctgcctttaaggagtaggaaacaactaagaacagatgatgtctcatgttgcgaatggatccttccttcctttgcttttccctcaagttctttctcatgcaagcgaacacccatattgtgaggggtagcaaatttaaatgagtcctttgcattcgagtatagagatgactgaggagaatgaggtagtttggaaacactagaaaaatctgcctcagtgcttttgatattttaatttataggcaattcttttaagtttcatttttctcaagacaaatgccagactgtggaaagggtgctgtcatttaaaaatattcgggcatgtggccgggtgcggtggctcacgcttgtaatcccagctctttgggaggtcgaggcgggtggatcacgaggtcaggaattcgagaccagcctggccaacactgtgaaaccccatctctactaaaaatacaaaaattagctgggtgtggtggcacctgtaatcccagctactcaggaggctgaggcaggagaatggcttgaacccgggaggcggaggttgcagtgagccaagattgcgccactgcactccagcctgggcaacaaagctagactttgtctcggggggaaaaaaaagaatatttgggcgtgcatactgcccaaagcgatttacagactctctgctattcctagcagattaccgaggaccttcttcacagaactagaaaaacactgctttaaaattcatatggaaccaaaaaagagcccaaatagacaaggcagtcctaagcaaaagaacaaagctggaggcattctgttacgcaacttcagactatactacatggctacagcaacctaacagcatggtacgggtacaaaagcagacacgaatggaacaaaagagagagcccagaaataaggctgcacacctacaaccatctcatcttcgacaaagctgacaaaagcagtggggaaaggactccctattcaatcagcggtgctgggacgactggctagccacatgcagaagattgaaattggaccccttccggctgggcgcggtggctcacgcttgtaatcccagcactttgggaggccgaggtgggtggatcatgaggtcaggagatcgagaccacagtgaaaccccgtctctactaaaaatacaaaaaaattagccgggcgtggtggcgggcgcctgtagtcccagctactcggagaggctgaggcaggagaatggcgtgaacccgggaggcggagcttgcagtgagccgagactgcgccactgcactccagcctgggtgacagagcgagactccgtctcaaaaaaaaaaaaaaaaaaaagaaattggaccccttccctacaccatgcacaaaaatcaacaaaagatggattaaagactgaaatgtaaaacccaaaactataaaaaccctgcaagacaacctaggcaataccattctggacacaggaactgacaaaggtttcatgaagaaaacacaaaaagcaattgcaacaaaagcaaaaattgacaaatgggatctaattaaacttaagagcttctatacagcaaaagaaattatcgacagagtaaacatacatcttacagcatgggagaaaatatttgtaaattatgcatctgacaaaggtctaatatccagcatctataaggaacttaagaaacttaagaactacaagaaaaaaaacaaccccattaaaaagtgggcaaagggcatgcacagttagttttccaaagaagatgcacatgcagccaacaggcatatgaaaaacagcccaaatcactgaccattagagaaatgcaaatcaaaaccacagtgagatagcatctcacaccagtcagaataactattattaaaaagtcaaaaataagatgcttattttgagggtatggagaaaagggaatcctaatacactgttggtggagtgtaaactagttcaaccattgtggaaagcaatatggtgattcctcagctaaaaatagaactaccatttgacccagcaatcccattactggttatatatactcaaaggaatataaattgttctaccataaagatatgtacacatgtgtgttcactgcagcactattcacaatagcaaagacatggaatccactgaaatgcctgtcagtggcagattggataaagaaaatttggtacatttatatcatggggtacgatgtaactgtaagaaagaatgagatcctcctgtcttttgcaagaacgtggttgggagctggaggccattatcctcagcaaacgaatgcaggaacataaaaccaagtaccgaatgttctcacttataagtgggagctaagtgatgagaacacatggacacaaagaagggaacaaccgacagtagggcctacttgagggtggaaggtgggaagagggagaggatcagaaaaaataaccattgggttctaggcttcgtacctgggttacaaagtaatctgtacatcaaaccctggtgacaggagtttacctgtataacaaacctgcacatgtacttctgaacctaaaataaaagtaaaaaaaaataatttgggcacgatgactcatgcctggaatactagcatgttggcgggaggatcgcttgaggccaggagtttgaggttacactgagctgtgattgtgccactgcactccatcgtgggtgacagaacaagaccctgtctctaaaatatttatctacatgatatatacatttggtgggtgctttggtcccaactgtctgtgaccatctggggcagagccagtgccgtgtgcaaggtgtactgcctgcacacagcacaggaggctggggctggccagggcctgtgcacctgctcctctgtgcctggcttgtggatgcccctcactcgctgagtcttttctgaagtcatttagcagcactgccactgctctaacctacatttaaagatttattttcataattttctggcagaaaattttattaatgtagccattttatttgtataatgattgttgagaatagaatattttatgttcaagatattgattaatttttggagaaactaagaaatttgatgttgcataacaaatctctatttaaattcacggtgtaaactgcagtgaatcattagtgtattaggtaaaagccaacattgcagaatatagtttatttgaaaggccgcttagatgaaaattctagggtgatctggaaatgttttacacttttgtatatgtgatcattggatgctacttaggagagtttgtactagtgtgtctagcagttgtagcaaggtgaggtgggtggccacatttgattatgaagtaaatttattctagagagtttatatagcatgaagaatattacaatcaaagaagtgttacactacatatcttaaacttttaacatgactcttatctagctataaaaatatgtctgacattttgtgttttaggaatgaagtaagtatgcagtggtaatgaatgtttgatcatgatttcaggtgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacaggtgtgagccaccgtgcctggcctccaaacaataatttaaatgatgtgataaattttattttagcctagccgagatcttaaaatctattttgaagtcaggcactagccttatttggttcagctaaaggtgctccctggtgcatcaggttgtgaatgtcatatatgagtcctaagggagtaaacaaactctggctgtgtcagtgctgaaattcaaaacagtaaaaaaaaaaaagatacttggttttaaaatggggtggatgcatctattgggctttattgatattttggaaattttgagatatgtattttgcctcttgctaaggaattagataatcgtgcagggtttgaattgacagttgtcaaagtcagcaaaaatactatggtcaaattgctgggtctttgagacctaggttttagtcctgttagctctgactttgggcaagttgtttgatgtaattgttttagttcctcaacaatccagaccctggccagcagagttggagcattgaatgatctttctaagataatttgagcgtacaaatggcaaatctgatttaacagcataactgttgattcttacggcacaagtcagtgagcctgtctttgttgaggtagtcgcggtgtgataacagacatagtagttaagaacactgactcgaggtagaccgctgtgccgcttagtaacgtatcgtgttgtgaagctgctgaatcttcgtactctagtttcctcatctctataacaggcaaatttgtaattgtgacaaataataactacaagaagtaaattaataactaagaccaaatgcatactgtgtggccagcaccattgtaagtgctgaggatacaaacctgaacaagacacattgctgtcttcagaaagctcacagtcagatgggagagagagaaggaagcaaggcaagtacaggcttgtaagtgttgtgatgggtgtccttacaggaccaggatttcaggaggtaaggtcagtttccctgggaagggagagttagagaaaagatgctcgcagtttaattcaacaaacaagtggtacctgctgggtgtgcctgccgtcctgctaggcattgagactacaggataaatttagcatgatccctgctctaaaggagcttaaagtttagtggaaaaccatgagtctagtgataaatagtagttgtcaagatacttgaatggagtcttgcagatgaagtgtttgacaggcagtggaagaacaaaaacacagaaggagacagtcgttgcggctggagcagagtttgcaagtccactcctggtgagggaggggatgctgagccagcagggcagggtctactcacacccagaggctggctcggaagcagcagatgtaaagggaagtgtgtattggagggggtatgttgtgaatttgatgacgtctgattgttacattgaattccatgagttctagacaatttcttcatgataattacccccttaaatttcataatcttcattcccccactaaatttaataccataacatttttaatttaaaaaacaccttttttgtcggtacttttgaaaacattttcctgcacctgtgccttctatgaaatgaacgctgtagagaatctgtggaaatcggctcatggtagaagctttccctgtcatatggatgagtccttttgcttgcccagtgccctcctggcatattgatgaggtaggattgggagttcggaacgcctacaaaatgagcaggctaatttcgaacggatgctaatcctgcaaaaccaagagagatgcttattggttgatttgccttttttttttttttttttttttttttttgaaacagtctcactctgtcacccaggctgtagtgcagtggcgcgatcttcgctcactgcaacctctgcctcctgggctcaagcgattctcctgcctcagccttctgagtagctgggactacaggtgcacgctaccacttctggctgattttttgtatttttagtagagacggggtttcaccttgtgggcctgactggtctcaaactcctcacctcaagtgatccgcccatcttggcctcccaaagtgctgggattacaggcgtgagccactgtgcccagccattatttgcttttagttgaatttgtgtgtttggagactgagcacttactttcaacagtgaagaaattgacttggcagcagttgctgcaggtggctgttttcggtctacctcatactgtcagtgtgtcgcccagatactatataattactcagttattttgcagtcacaacatctttgtgtgtttgtatttatttagtaattagaagaaagtttttatgttctcatagtatcttcctgtctacacagtgcatttgtttactaatttatatccatttgatacacatctaatgattgcctctgatgggtatatgtgggaacatgtacattccctactgttagctgcaaatagtgagaagtagttagagcataatgtttcacatcgaagtaatctctttttcaaagacatctctgagaatgaaaacattaagtttggcagttccgacaaactcttatagtgataaggtattagtctaattctacttagtaagaaagttattcccggagacttccatttccactatgatggaattagaggtgatttacgccccccaacccaggactagggtaaggcaagtgaggcacttgcctcagtgcagaatttaaagggacacccaaaatctcagtaatcgagattattaatattttaatgcagtgctttaaaaaaatcaaatttgatgcaaaaaaaatccatgatgaaaaacaaaattattttttactttttaagacagggtcttgctctattgcccaggctggagtgcagtggagcaatcatagctcactacagctatggtaatacagatgggtgggctcaagtgatcctccagcctcagcctcctaagtagctgagactacaggcacatgccaccacgtctggataattttttatttttttttgtagagtggtgtctcactgtgttgcccatactgatctcaaactctgagctcaagcagtcctcccgtcttagcctcccaaagtgctgagattattggagtgagccaccacgcctggcccaaaacccaaatttgaaagacaggatcagtattaatgatttttctttttgtctcaagctccagcatggcttggcaagacaccattatcgatattatatataaaactttggtattttgtacctcgtggattttttcattaattttgattttatctctattactgagtttttttgacactcaattaagatttgtgcctaaggcaagtacctcacttggcttgccctagtcccaaattgacttctatcttaaacaacttgaaaaccagacaaaatatatgaagtaatagttttcatacatttgacagaaggctggttaggaccatgttccttgaaataaggggaacaaacaaaacaagccctgcagtattccagcttataccccacagcatgagactgcacttttttctataaagggctgtatagtaaccattgtaggttttgggggccggatgctgttaatgtcacaactactctgctatgctctgtgcctgctttcatcctaagtatgtaagtgaatggacgtggacgcattacaataaaacctttctgacacaaacagccttagtttgtctcgagaggcagtttccatgtttcagggcaggaagagagaagtcaaacagaacccactggcttcactaaagtgatgatacaggagaaattggggaggacaagacagctagaatttgtggaggaaaacataggagaggagggagcaggttagagagagagctctagagatctgcagaagggcccccttgaggcgttggctgcatcctggtctgcacgtggccaagaggaagcacctcaaggctgggaggagaaccaccaaaaaggagaaggccaagcacttcttggacatcagttgcacagggctgggaatagtttgtgttcccaccacccagggtggtctcaggtagatcctttgaagggttgccttttcatctttgttagcgtgggttcagagcagctttttcatctatggtgtcaggacgattcctcagaagggctgccttagcagtggggctgagttatccatagaccaatgggctgctcccgacttgccctaactgattacagatagcttgattacattatcagaaccaaagccccgactatatttaaaaaggatgtaataaaactagcacccaaaaatgtaaaaagaaattgtgtctagcatctaataaataattaccaggtatgcagagaagcaaggaaatgtgatattaaccaggaagaaaatcaagagaaacagaacccagaaagacaagggatgatgcaattagcacacaaacattaaaataacttataaatatgttgcacactcaacataaaacgtagagaaaaacataagcatactgagtgaaatgaaagactcaaaaaagattgaaataaaacttccagagatgaaaatagaatatatacaatatataaaatgccgggcgcagtggctcacacctataatcccaattctttgggaggctgaggtgggcagatcatttgaggtctggagttgaagagtagcctggccaacatggcgaaacctcgtctctactgaaaatacaaaaattagccgggcgtggtgcaggcgcctgtaatcccagctactcgggagactgaggcaggaggatcacttgaacccgggaggtggaggttgcagtgagccgagatcacaccactgcactccagcctggcgacagagcaagactctgtctcaaaaataaataaatagataaaaataatatatattttatttatataataaaatatataataaaataaatttatatatagtaaaataatatatacacatgtatatgtatatataatgcagtagagggatcacaacaggttattacgacagaagaaaagagttcatgagcctgaagacgtagcagtagaagctttccaaagcacagcacagagaatccagactgcgcgagatcacagagcatcagcagcctgtgggacaaagtcagctgacttaagatatgtataacctagttccagaaggagaagaggagggaatggaaaaaatatttggagaaataatggctggaaattttccaaatttgatgaaaaatgcaaactatgaagctcaaaaactccaaacagagcaaatataaagaaatccaaggtacctcataatcagattgccagaaaaccagtgatcaagatcaaaagctttcaaagcagccagaagaaaagacacattacagaggaatacagttgctaataacagcgattcctggtcacatcttgtgtgaaccagaagacaacagagcaacatattcaaagtactgaaagaaaaaaacctgttagagttctgtatctggcaaaaatgtctttcaaaaatgaaggataaatttttatttatttcagaagtaaagaaatttttaggccaggcatggtagctcacacctgtaatcccagcactttgggaggccgaggtgggcgaatcacctgaggtcgggagtttgagactagcctggccaacatggtgaaacctcgtctctactaaaaaaaattagctgggtgtggtggcaggtgcctgtaatcccagctactcaggaggccgagacaggagaattgcttgaacccgggaggcagaggttgcagtgagccgagatcgtgccactgcactctagcctgggcgacagagggagactccatctcaaaaaaaaaaacccaaaaacaaaaataaatttttaggccaatagacatcagaatttattgccagcagaatggcactaaaggagtattaaaggaaattcagatagaaagaaaataatatttgatgggaaaaatttttatttatatatattttggagacaggatctcactctagtgtccaggctggagtgcagtgggtgtgatctcggctcactgcaatctctgtctcccgggctcaagcagtcctcctgcctcagcctccctagtagctgggactataagcgtgtgccaccatacccagctaatttttgtattttttgtagaaacggagtctcactgtgttctccaggctggtctcgaactcctgatttcaagcaatccacccatctcagcctcccaaagtgctgggattacaggcgtgagacactgcactcaggcttaaatagtcagtttccatctggggccaggcatggtgtctcacacctgtaatcgcagcactttgggcaggaggagagggcagattgcttgagcttgggagtttgaggctacagtgagctatgatcacaccactgtactccagcctgggtgacagagtgagaccctgtgtttctaaaaggaaaaaaaaaagtggtaaaattgacaaagctccagtgaaactgataaggaagaaaaaacagatataaataatgaaatgaaatgaaaaaggtgaaaacactatggattcagtagactgttaagatatcataaaaggatattagaattagcatcacgctatatacatttgaaaatttagataaaatagacaaatttctttcaaaatgtaacttaactaaaagtaactgaagaaatagaaaaccttaaccagtcctatgactattaaaaatgtttagatttaaacaaatgtatgattgagggaatgctgggaatgtgtgtaaacacatacatatgttgtcatgtgttaccttaattgacctatacagttcttgagtacaagattaaaacctgtttctgagtatgtgattgtatcaatgagggctctttctgatgtaaattttgagaaattcaaccttagttgttttaagtaagtaaaaagaaggtttattgatcatctgattgaaaaacctaaggcagggctagctatagatggttcacttgggccagtttcttccccagcatcctccttcatgtgttcaggttctttgggaaagagggagaatctctataagtcccatagtgggaagaggagacccattaatcctgacctgggttgtgtgttcagagatgagccaactctgggcaggaaaataagatgctctgaatgaccaggtgcaaatcacaggctttacctgggcccaggtgttggagtcagcgcccctggaagctgtggactgagctgggaatttatacctgacaaggatcagggtgcaggaaccatggggaaggtgaacaaatatttggctacaaaattaaatctccattgcagtaattgccagatgtaaaatttcatgaattctttattcaaaattatgatgaaattctataataaagaattcttagttggccaggtgtggtggctcatgcctgtaatcccagcactttgggaggctgaggcgggagggttgcttgaggccaggagtttgagaccagcctgggcaacatagtgagactcccacctctaaaaaaaaaaaaaaatgttgtttttgttttgttttttttgagacggagtctcgcactgttgcccagactggagtgcagtggtgcaattttggctcactgcaagccctgcctcctgggttcacaccattctcctgcctcagcctcctgagtagctgggactacaggtggctgccagcacgccggctaattttttgtatttttagtagagacagggtttcactgtgttaactaggatggacttaatctcctgacctcgtgatccacccacctcggcctcccaaagtgctggaattacaggcgtgagccaccatgcccggccctaaaaattttttgtttttttttttgagatggagtctcactttgttgcccaggctggagtacagtggtgcaatcttggctcactgcaagctctgcctcccgggttcaagtggttctcctgcctcagcctcccggttagttgggattacaggcgcacgccactagctctggctaatttttttatttttagtagagatggggtttcaccatgttggtcaggctggtctcgaactcctgacctcaggtgatctgcccacctcagtcttccaaagtgctgagattacaggcatgagcaccgtgcccagcctaaaaataaaaaaaaaattttttttttttttcaagacggagtctccctctgtcacccaggctggagtgcagtggcgccatctcggctcactgcaagctctgcctcgcaggttcatgccattctcctgcctcagcctcccgagtagctgggactacaggcacctgccaccatgcgtggctaatttttttgtatttttagtagagacagggtttcaccgtgttagccaggatggtcttgatctcctgacctcgtgatctgcccgcctcggcctcccaaagtgctgggattacaggtgtgagccactgcgcccagccaaaaaaagttttgaatttgctgggtgtggtggcacatgcttgtaatcccagctactggggaggctgaggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaaatactattataccgctgttcagttagcaggaattaaaaagtttggcaattgttgttgaaaaagttaagcaacagaaactctctcatacccttctgatgggagtgcacattacagctgctttgggaaatagtttggctttagagtataagctagcaatcatacttctaggtatgtacaccagagaaacacatgcctaaagtgattgagatagctgtaccagaaaaatcttaagtcgtgtttatatttgctccaaagcagagaccaccctcggggatgagaatggataactaaattatggtatatttactgagtagaatattacacagcaatgaaaataaactacagacacagcaacaacaaaaaaggcaaagaaaaaagcaagacaagaatatatgtagtatgattttgttattttcatctgcttctggtttttatataagttatgtttggtagggctgcacacctaggtgataaatctctaaagaaaagtttggaaatgataaaccataaaagttaaagcacagtagctcatgcctgtaatcccagcactttgggaggctgagatgggaggatcacttgagcccaggagttccagaccagtctaggcaacacagggagatccagcttcttaaaaaaaaaaaaaaaaaaaaaaaaaaaattttccggacacggtggcatcctcctgtggtcccagctacttgggaggctaagatgggagaattgcctgagtttgggaggtcgaggctgccgtgagttgtggttgcaccactgcactccagcctgggtgacagagcaagatgctgcgtcaacaaatcaaacaaaatcattttgttaaagctagtacttacttacgtatgtggtggaagggttttggggtcagatagaggcacccagcctttctggagttctggcaatgctccatcccttggtggtagttggactggtatttatgtaataacttcatgaaacggtatacatatgttttctatgcttttctataagtaagtaatacctcatagtaaaagcagttttaaaataatcagattttatagtgcatgttccattaaaaaaatgtggaaaatccccaaagcacatgcatatacagtagttaatcatgttttatcttaaatttattcatattatagaaatttaccttttgaaatttcatttttatttatttgagatggagtctcgctctgtcgcccagactggagtgcagtggtgtgcatgatctcagctcactgcagcctccgcctcctgggttcaaactattctcctgccttagcctcccaagtagctgggattacaggtgtgtgccaccacgcccagctaattcttgtatttttggtagagatggcgttttaccatattggcccggctggtctcgaactcctgacctcaggcaatccaccctcctcgacctcccaaagtgctgggattacaacatgagccactgcgcctggccttgaaatttcatttttaaaagctctaaaaattttccaggtgagaattgaccaactattattattttctgggtaagggactccactacagtaattaaagaaggataaggttggcgttgctttgctcctttttttattgaagtccttccttcctgatcaagcttccatatatctccttaaaacatatgacacacaggtatgccactaaaaaacttaatttgtgtagatttctttcttcagctgttactttttcatcttgcataaaaatcaagtaattaaattttaaaacatcctgaacatattcatttttggctttagcaatttcattcttcagcagatgtatttgactttctatatacatggcactttggtttggtttgtgtctgaccttatttttatttttcattttttttcaaaccagtattaaactgaaaataatagacgtcatacctcatggcccaggaatgagtgaataagttggaaaaccaagagtagtggcctgcatctctttgtccaaggcctactttccaaaatctctcggccctacccttccctagaaggttccccactgcaaggaaggcacaggcagcctgggggtgtgacctgcctcatggagtattgcattttttgatacaagaactatttgctccttaacatctttctctaggagtttgaaagaaaagaaattactctgtgtttcagtctctaacttgtgattgagtggctgaggtgggaggatctcttgagcccaagagttcgataccagcctgggcaacacagtgaaactctgtctaaaaaaataaaataattaactgggggtggtggtgtgtgcctgtagtcccagctacatgggaggctgaggcaggcggatcacttgagcccaggagttccaggctgcagtgagctaggatcatgccactgctgcccaggctggccatagaccaagaccctgtccctttaaaacataataataatctttcatatgttagaatgttaaaaataagtataagaagtttgaaatgtttgcatccaaagtgagatttaatacatagctatttttgataaattgaaaagtgtcaagaaaactgctgtttaaatttcatttataatcatgatctcataatagtaccattcaattttctccaatagtctctggtatttttagtttgtttgaagcagcgtccaaataattgcagttaactgataggtctgttaagtctcttaatcaatagaatacttttccccatcccttttttccttgcattttatttgttggaaaatccaggctgattgttcagtagtcagaagttccctcattctggcctttgctgtttccactggacatgttcttctgcctgtgggtggatatagaggctcgatcgctttctggctcagcctttcagcacaggtacttcagaggtgcgtgatgccctcaccaggaggcacacatctgcactgatgtgagatccagtgttgttgttgttgttttttccttttgtcttttttatttaaaaatcatggggtcttgctatgttgcccaggctggttttgaactcctggcctcaagcagtcctcccacctccgcctcccaaagtatgctgcaagcttaagccatggcgcctggcagatctagtgttttttgaaatctcatgttttattctaacaattgatcgaaacattataatctgcttctcaatatggccatgttttatgcttttcacgtcttcaaatacagttgacactccaggaagatgaaccttatcacatttgcaacttctgccccttatacagccccggggctccagccccatgtggcaggcgtgacctaggggaagcctccatctggagaagtgctgcctgcacttggttgcatatcgagtggactgagcccttggctcctctcgctgcttcctgtccagatggcaggactctggtcgtgggccaaaagaggcacagtgtctttgcatataataaggattgaatgaatactttttaaaaatcctaactcttatgaaccaagggatactgacaatgctgggccccaaataactattgttttctcaaaggctttaagaccatgtgttatactgtgatttaatcaggttctttcctaggagtctgcctgagtcacttggtctgtgtgtctctccctccctgtcctaagggggcttttcatgtgtgactgtgttctgcctgcctgtctggtaagaatccagcctcctgttacttgcccaggatgctgactgtgggccctctcccgcagtggaacatttggcatcaggtaccaggaacagagtcagtatgctgaaatgtttgcatgaatgtggattttcagaaagctttcttatcagcagggcacacctgtctgttcgtgatctttgcccttctccctttattggcatcacttggacgatacctttaattgccctgctgggcttgatgttgagctgcttttctccatgtgtgtcgtgttttgtgctttcttgcggcaggagccttttgctttgtttatctgatgcttcccttttttggttttccccgggctttccagctcttggagcacccttttgtcagcagatgtacttttgtttccagtttttaaattctaattacagtgtaactcaactaaaatcatggaactggggaacataaaacaaatcattagggtaatggaggcatagaagaaagtgaaaggaatccagtccacctctttgctgtactaggtatggatatgcctcagctgtgagtgagggccttcctgagtagctgactacaaactaaacttttatgaaagaattttcttaaataattagagatgcctttcatttagctaaaaacaagacctcaaaatacagtaaattcatgtctaagactgtagcaaacagtaagtaaagtaatagagtaaaaattctgcttaaagaagactgcagaataagaattgcaggccgagcgtgctggctcacacctgtaatcccagcactttgggaggccgagatgggtgaatcacttgaggtcaggagttcaataccagcctggccaacatggtgaaaccctgtctctactaaaaatacaaatagttgggcatggtggcacacacctgtaatcccagctactcaggaggctgaggcaggagaatcgtttgaacctgggaggcgtaggattgaaccaagattgcgccactgcactccagcctgggcgatagagtgagactccgtctaaaaaaaaaaaaaaaaaaaaaaaagttacagcgctcagagtgccagatgctgcgctcctggtagtttctggtcttggcccttccttagctcaaagtgcactggcataggtgccattttttagtcacacaattcccttcattgtaattttcttagcactgtctttgcttagtggatctgttgttgccattcagcagtacatttctctctgtgtggaagcaaacatcttctcaaacctgatgctcagtgaggataggcagtgggctattaaataggcagtggcctcagattcccagcatgtgtatgattgccgtgctaaccagaggcgcatgtgtccagcatctgggcattggaacctgcaagctgctcccccaaatcaggatgccaaacattaattggcaagttactaaaagttgcctcaaataccatctttaatgcatttaactgaatttgcataatttttctttatcagcacaataattattataaatattgtagaattgccattaacttataattgtcatatctaaattttaggataaaaatagaacttaactatttttatacccatatataagcaagtgaagtaaaggtatttatgtttaaatcaagaaatctaatcaaaggtttttacaatccttccaaatatgcaatctcacttatttcttgccacttctggtgataggtctgtgtgtggaagacacgggattcctgcctgtccacagctcagtgtgaacggaccagatatggtcacagattagaatttaccatcacagggccgggcgcagtggctcaggcctgtaatcccagcactttgggaggccgaggtgggcggatcacgaggtcaggagattgagaccatcctggccaagatggtgaaagcccgtctctactaaaaatacagaaaattagccaggcctggtggcgggcacctgtagtcccagctactcaggaggctgaggcaggagaatggtgtgaaccctggaggcggagcttgcagtgagccgagatggcgccactgcactccagcctgggcgacagagcaagactctgcctcaaaaaaaaagaaattatcatcacaggcctcgtgggtggttcgtgtaagaggctgaggcaggaggattgcttgagcccaggagttcgagaccagtctgggccacattggcgagacctacctgggcaacatggcgagaccctgtctctacaaaaaatagaaaagttagcggggtgtggtggtgcatgcctgtagtcccagctggttgggaggctgaggcaggaggatcgcttcagcctgggagttcaaggctgccgtgagccatgtttgcaccactgcactccagcctgggtgacggcaagaaaagaaagaaaataaaagaaataacctcaaaagaaaaaaaagaaaagaaattacctcaaaagaaaataaattacccttacagacattttatttttattttattttttttacagacaaggtctctctcttgctcaggctagactcaacctcctgggctcaagtgatcctcctgcctcagccttctgagcaggcactacaggcacacgctgccatgcccgacaaccaccacagataatttagaaaaaattagccttttagttttaggagctttcttttacagtgatatttagtttggggcctttgaacttggtctttgcttttggagctgtacttgtaggtgttgttgttccagcctgggaacgagacatgaccgactccagtgcggcctgcttgctgtcctcaccatcagtcagtgtggtccgtgtgtgaggctgcagttgtcctcttggccacttatttctccttaattctctgcatgtaatttaaaacattatcccctgaaacttagtttttcattgacttctaatatctttacttctccttttaattttcctattgagatacttaggatgacatgaaattctttggatctacatatggacaaacagaattgtgtcacataaggttcagtgtgctagctgtttaaaaaaaattaaaaacagtttgttttttttagagacagaatcttgccctgtcacccaggctggagtgcagtggcgtgatcgtagttcactgtaaccttgagctcctgggcttaagcagttctcccgcctcagcctcttgagtagctaggactcacaggcatgtgtcaccatgccaggctaatttttattttatttttatattttatttttattattatttttttgagacagagtctcactctgtcgcccaggctggagtgcagcggcacaatctcggcttactgcaacctccacctcctgggttcaaacgattctcatattctcctgcctcagcctcctgagtagctgggactgcaggctcacaccaccacgtccggctaatttttgtatttttagtagagacagggttttgccatgttggccaggctggtcttgaactcctgacctcagacgatcctcctgccttgcctcctaaagtgctgggattacaggtgtgagccattgcacctggcctttatttttttttagaggctgactgagttttgctgtgttgccaaggctgatctcaaactcctggtacttcaagcagtcctcttgccttgacctcccaaagtgctgggattacaggtgtgagctaccacgtcctgcctgctagccatttttttatgttcgtggtggtggtaaggagtggctaccaggctgtgcgggattcaggaatctggatgttccccccaccaccgttttttaccccacgaaaaaaattgtaaacactttctaattgagataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctcgccaacatggtgaaacccccatctctactaaaaatacaaaaaaattagctgggcatggtggcacactcctgtaacctcaggcaattgggaggctgaggcagcagaattgcttgggcccgggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctggacatttcatgtaataggaatcatacaatatgtggccttttgtttctgacttctataacttacataatgttttcagggtccatccatgttgtagcatatatagtacctcatttttttttatgcctaagtaagagttcattgtatgaatagaccacattttgtttatccatttaccagttgaccatttgagctgtttctactttttttttcgctattgtgaatagtgctgctgtgaacgtttgtgaacaagtttttgcgtgaacagactggttctcttggtatatacatagagatggaattgttgggtcatacggtaattctgtgtttaacttttggaggaactgccagattgtttccacaagggctgcaccattttacattcctgtcaacaatatgtgaagattcccatttctccatatccttgctaacacttgtgattttctgtttttaaaattttagccatccaagtgactaagtggttatagtaggttttggttttggttttgagacagagtcttacttttgtgttgcccaggctgcagtgcagtagtgcaaacatggctcactgcagcctcacctcctgggctcaagtgattcccacctcagccccccagatagctgggactacaggtgtgcaccaccacacccagctattttttgtatttttttgtagagatggggttttttactgtgttgcccaggcatgtcttgaactactggcttcaagtgatctgcccacctcagcctttcaaagtgctgggattataggtgtcagctgccgcacctggctgtttttttttttttttttttaacaatgttttaaaataaattgtggtgagatacacataacattagccatttaaaagtgaatgattcagtggcattttgtacattcacagtgttctgcaccatgatctctatctggttccaacacatttttttcgttcccaaaaggaaaccccatacccataagcagtgagtccccattatgcctcctttcaaccactggtaactaccagtctgctttctgtcttgtggatttccctattctgtatgtttcatgtagatgaaatcgtagtgtgtgccctttgcttctgacttactcacttagcatgttttcagggttcatccatgttgtagcatgaatcagaacttgattcctttttaaggctgaatggtattcactgtctggatagattacattttgtttattcatgtattgatggacattttggtggtttctacctttttggttgttgtgaagagtactgctgtgaacatgtgtatacatgtgtttctttgagtaccttttttcagttattttgagcatgtacctaagagtggaattgctgggtcatatggtaaaatgttttaactttttgaggaactgccagcctcttttccttagtggctgaaccattttgcgtttccacagcagtatatgagggtttcagtttttccacatcctaacacttgttattttccttttttaaaaaaattataggccaggcgcagtggctcacacctgtaatcccagcactttgggaggccgaggcaggcagatcacctgagctcaggagtttgagaccaccctgggcaacatggtgaaaccccatctctactaaaatacaaaaaattagccaggcgtggtggcaccagcctgtagtcccagctactagggagcctgaggcacgagaatcacttgagcctgagggatggaggttgcagtgagccaagatcatgccaccgcactccagcttgggctacagaatgagactttatctaaaaaaaaaaaaaaaggccaggtacgttggctcatgcctgtaattccaacattttgggaggccagggtgggaggatcacttgagcccaggagtttgagaacaacctgggcaatataatgacaccccgtctctacagacaataaaataactagctgggcatggttgtgtatgcctgtattcccaggtattcgggaggctgagttgggaggattgcctgagcccaggagttcaaggctgcagcaagtcacgttcacaccactgcactccatccagcctgggcaacagagtaaaaccctgtctcacaaaaaaaaaaaaaaaaaaaaaaaattacagccatcccagtgggtgtgaagtgggaactcactgtggttttgatttgtattttcttttttaagtgaaagcaagtttattaagaaagcaaaggaataaagaatggctattccataggcagagcccattgccactcagctgcttatacttattgttacttcttgattgtatgctaaacaaggggtggattattcatgagttttatgggaaaggggtgggcagtatctggaactgagggtttctcccctttgtagaccatacagggcaacttcctgacgttgccatggtatctggaaactgtcatggtgctggtggaagtgtcttttagcatgctgatgcattataattagagtataatgaatagtaaggacaaccagaggtcactttcatcgccatcttggttttggtcagcttctttactgcagcctgtttcatcattaaggtctttattacctgtatcttgtgccgacctcctgtctcatcctgtgacttagaatgcctaacctcctgggaatgtagcccagtgggtctcagccttattttactcaccccctattcaagatggagtttctctggttcagacacccctgacatgtttcccccctcccttttacagcagaacccttaatcctaacagtcgtagagggacaaagatccatcttctgtaacttcttcaggctgaatggggcgatgatattcctgcctaactatgagggtctcttgtattcagggtagagaagagctcagtcagaaagcatcaatatggtgagggccattcatagctctgagttccaacaaaaggtggtatctggaagattaataagtgttcagtttaagaaaacattcagtaaacttatcctgcattcctacacaaagagtacaacagcaatatattccacaacagtaaagtagaataactaaaattatcctgagtaaactaaacaagaaggctttccatgaactgggcagttgttgaaaccaaactgatacatcgggttgctagccgactccagtatgtgcccagaattagaatattgatccagatttttacattacccatctctcttgtttcttgtgagcagcagccagagatcactgattggttcacaggagtaagcagggttagcctaagttgcagaaaaaaaacttaaaaacaactgatgagactagaatctagtaacaggtgtaccaagttcctgaaacataatttattttctctctccggtctcccatttttactgaagacaaatcatggtacaactgatttgctttattatacttggcctgattatttgtataaagtgcagcaagaacagttatttttcacataggtttttaaaattggctttgatgaaacttcattccataaaaggaagcttagataagactttttgttaaagccaagcccagccatgggtttgtaccctcaaataacctgtgagttgggaaattcctctcctcttgaggtcccaagatggcgtggggttcctgggcctgtcggaaagtgacattctttactaaccacaggtcaggaaccctgcacaggaactgtgtagacaaggtatgaggccagttttcccaaggaacttttattggctccataagtcaagtttgagtccttaaaggaaagcacaccattcccatcaaagtcctggtaaaacaactagtttctctaattgtgtcctgttgcaaaagaaaacagattcttattgcacttgtgcaaataactatattgccataagttaatactcacaaatagtttccaaattccagagaaagcaggtagagaaaaacaaatatgctccaaattttgttcacaggagtatactttactcaattgtcaaaagctgtaagtagctcaaaagttttcttggctctgaaaaacaaaaatgatcagcaacgttttaagcaaaaagtcagaaaagattacttgagtcttttgttcagtccatgcagttaactcctgttctacttgatattcataatcatttcagctctccatgagagtcctgaaagaacctctgttcttcttttttttttttttcttgagacagtctcactctgtcgcccaggctggcatgcaatggcgtgatcttggctcactgcaacctctgcctcctaggtttaagcgattctcctgcctcagcctcctgagtagctgggcttacaggtacgcaccaccacgcccagctaatttttgtatttcttagtagagacggggtttcaccacattggtcatgctggtctcgaactcccaacctcaggtgatccacccacctcggcctcccaaagtgctgggattacaggcgttagccactgcacccggcctaagaacctctattctaatgtcacaatctccaaagttattagaaacctgcatccaagagcacctgttgaagtcctataatagctgactataaaccaccttttgaagaggatcaacacagcagttgtctgtggttgacagaaagtcttaaggcagccactattaaaggcacaattgactaggaattttgattacttttgtggcatacgattttacataataattgtaattattagtaacatatgctaagtcatatcacaattctaggagtttcccattactttggaacacataccaataacatatttatataaatacaggtcaaagaaagccaaacaccatttcatatttgacagtgcttcctgtatgatttttataccaaataagccaaatttcaccattgcattagtgtactattaatgttaaacccaattcttaataaaacattatagacaaatctacccaattttaatgtcagaccagaaggtaagattcttataaaccttttataaccctttacaaatttttgttaaagagcagatcagtgctctaagaaaaccttgttacgcttttattccagtgttcaatttacggaactgtatcatacccctttaacttcagccagtatgttcacacacagaatttcttttaaaagattaatttttcacaaaatttccacaacttttgcaaaccttcagctttatcctaacttaaaacaatcccttaaccctttaatttaggccaaaaaaaaaaaaaatccacattcacatgtctccttctcttttaccaaaaacacatttcactttccctacacaccttgcatgtaaaactgtttttccagtagtctcaagtagatgttacactgttaactcttagcagtgtttatttttagtgaaaaacttggtaagcaattttaattatgtactaggtatggagcctaggacaccaggcagaagtgcagataaggtctgacacttactagcatagctaggaggcatggctaactccacatgtccctaggccttacctagaatctaatggctgtaggtaagtttaacaattttcaaaagtcaaagaggcagtttataaagttaaagcgtttagcaaacctaaaatttgacctgcctgatttagaccgaatgtctttattttaccaataatctttaaaattttctttacttcccacagcttaagtcacacgaattaaaaggcattacgctttttatttttctgacaaaatatttgatttaaacacttatttttaagccaattaatcaaagccttttatatcacacacacaacacatataaatacacagacagaagaaaatgtagtagttgtaaggtttttcctttgccagtttcttaattggattagtggctttatggtggagccctggaggaacagggcaaggaaagcatgcagtttctatggcctaataagcaggcacaattggaaggcaagacagagccccaaaacttgagggtcccatttttatattgatcctggatcccccaaagagaaacgctacagaacacaacagtgcaatgattttaccacatatttcattgccaggcaacccagagccaatcagccctttctgagatcagcccatcccccatgggagtcttatctctcagtggggaagggtgaggacatctccataccttccaggtggccaagagcatgctcttaatccagacacacaaagatccaagtatcccccacagtgccatttagccatccccaaaagtattaaatgtatttcctacctagttatattacacaccaaagttctctcataatgtgaagtaatttctgatacccccaaagtaaaaaacagataatgcagtgcaaaacagaacagagccatagattttgagagggatctatccacttttaataattctcggggttccatgaggaaaatagaggtttttcccaaaacagggtatgtggtgcctcctctgtttttcctaagaagtcccaggctgttagagcttgaatatcgacttttaattaagctgacttttaaccatagcactctttaaaaagtcgttttaaatatcttattacccaactttagccacgccaaactgccaatattcctggctttttaacttttccaaatgtaacctcccaggtgctgagagaaaggaaaatttaagacagtttatgaaagggaggagaatcaacaaatggcacaggtcacccaaatgccaaccagaaagtgctcattttctaggctaaaaattgaacctgaactcaggccaccattgtgaaaagacaaagccttaactgctaagctacagcattgggcagtttccactgcttttcccagaaggagcccagagcagtaaattttgagcttgcaaaggcttttaactgctcaagataatttgtagagctaactactaccccaaaatccctgttgcctggaaggcagagacaaagagaaagtactgccatatgattacaaggtcaagctctcagggacatttctcaacatgtggtctttgggcaagatggtggccctgaataacagaaaagataggaaagggaaaggaaagaaagggagaaaagcattgcctgcagcaggctggggaatgcaagaagctcagggaggccagagaaagacccgcccattgcagctgacactgaatcagaagttcaggtggctgctttttgggagcgtagggatctttcccagcattcccatcagctctagtttccccttttggggaggaaaaagctccccatgtcccataatcttggacatgtctagttctgtcacccacagccatcagcaaagagtgcaaggcagattaatccaaagagaatagcagttaacatcccatagtgccaaactggttcttagtcgagagggactctactgagaggggcctccaaccccctaaattttaggaaggactctaaccttcctaagttgggcatcaaacccaagttcagtcaagcgtgcttgccttttattaacaggcacctttatccctctcttaggagagactctaactctcctaagttgggcctctaacccaatcccatcctttacccaggtaactgcatcccacttacccaaggtcggccaatcagtgctgcagtctatttcctttgggttgggagtctcctcagtatcatccctttggggcttgccaggaagatgttaccggaaaggggtcccaatccagaccccaagagagggttattgaatctcatgcaagaaagaattcagggtgagtctataaagtgaaagcaagtttattatagaagtaaataaaaaagtggctactcaataggcagagcagccgatttgtattttcttaatgatattgatattggacatctttttatgcgcttgttgaatatttcagtatcttccttggagaaacgtttatacagatcctttgctcattttaaaattgggttgtctttttgtggttgagttataagagtgctttatatatatcctggatgctaaacccttattagatatgtgatttgcaagtatttcctcccattctgttaattgtcttttcactttattgataatctcatttggtgctcaaaagtttttcattttgatgaatgaagttcagtttatctagttttttattttgttgcttatacttttgttgttgtatctaagaatccattgccaaattcagggtcattaaagatttacctcctgtgttttcttctaagagctttctaatatattttttggggatctcattcatttttgaaagatagttttactggatatagaattcttggttgaaaaatagccagacatgatggcactggcctgtagtcccagctcccagagagactgaggcaggaggattgcttgatcccaggagttggagactgccgtgagctatgattgcaccacactgcactccagcctgggtgacagagtaagatcccttctccaaaaaaaaaaaaaaaaaaaattattggttgacagatttttttctttcagccctttaatttgtcacctttcggcctccatggctttagatgagaaatcagttgttaatcttactgagaaatccttgtacttgaagagtcacttctctcttgctgctttctacagtttggctacagtgtgtctgggtgtggctctttgaatttatcctacttggagtttgtcgagcttcctggttatgcagattaatgtttctcattaaatacaggacttttctaccattatttcttcaaacttttttttgtctttttttctctctgtctttctaagaccctataatatgtatgttggtacaattgatggtgtcccacaagtctctgaggctgtttattttcttcattattttttcttctgttccttacactttataatctcaattatcctatctttaagttctctgattcttactgctgtttatttctgctgttgagcccctgcagtgaatttttcatttcagtttttgtgcttttcaactccagaatttttgtttggttctttttttaaactatttttttctttatcaatattttctattcagtgagacattgttctgatggatcttgtagatttttgaacatggttttctttagttctttgaacatatttaaaatagcatatttaaagtcttcatccatacgtctaatgcctgggcttcctcttaaacaatttctgttagttgccttttttctgcatgtgaaccatactttcttgtttctttgcatgccttgtgatattttgttgaaaactggaacttttgaatttttaccgtggcaactctggaaatgagattcttccttctcccccagggtttattgactgcttgttacagtcattgtttgtatagttacttttctgagctaattttatatagtatatattctttatcatgtgtggcctctgagttctctgttccattaatatagtggtcagcttgtgattagacagagatttaagcgcctagaacaaaaaatgtctcccagtcttttgagatgaggtctgtgtgtatgttggagcacaccttcaacactcagccaggcatttgacggtgatccctgagcattcgctgcctgcttgcacagatcctgaaggtcagccagaggtgaaagcctagggccttttcaggtctttcctgaacatgtacacagccctgggcatttgtggagccttctggatttccaagaatgtgtcagagcttttcaaacctttattttccaaaacatcttactcctcagcttttcttcccaagcttttggttaaatctattgtttgcctcaactgttattcagtgcttcaggcagcagcaaatatgtttgtctgtaaatgtttccaataaccttttcccatctttccctagtagatgcctcagcactgggaggtaaagtcaagccctttgagccagtcttccagggactcagtagacaggtcgaaacaaacaactgcagttctttgccgatgaggcccattctgctccctctgggaccagtgcatgcaccggagtggcagcctcttgtcttctaggccactgcggcagccaggatgggaccagagaaagttaaaatgccatggaactcgcggttcttgctgagattcacctggtttttcttgattaagcattcttctgattgctgcaagtttttaattagttttccaaagttttaaaatagtagattctaacggtttttgcctttttcttttttttttttttttttggagacggattcttgcgctctcacccgggctggagtgcagtggcgccatcacggctcactgcaagctccgcctcccaggttcacgccattctcctgcctcagcctctctagtagctgggactacaggcacccgccaccacgcccggctaattttttgtatttttagtagagatggggtttcaccgtgttagccgggatggtctcgatctcctgacctcgtgatctgcccacctcggcctcccaaagtgctgggattacaggtgtgagccaccgcgcccggcctagtttttgccagtttttaaaatgtgtatattgaaggatggactttgagttccttactcagccatttttgtggacatgatttactagtcataatttaaattgaatattttaggacatattaaattatgatcagtttcgaggttgccaaatttacgtacaccttacttggttacacaagagatttaagatggcttacaaggataaatagcataagagatgcaataaattatcattgtcagtatttgttgggttgagggcatgttagtaaaaactgccctccctgctgttaagaacttgatcctacagacagaaatgtttccttggcagccttgagattcttgccctctctctgttacgtcagtggtggggaacctggggcagattcgcctccgtggcttctcctgcatgactgcgttgggctgagggagatatgccaggttagtgcccagcagtagggatggttgttactgtctgcctctgagttgattgtgagaaatgtgtctccagtgttggttttcctaaatctaaaactctcctttgctcaggacaggacaggtaagtgtttatatcctatttgaggacttaagacatcatgtctattgtcctatttgcttcaggaggtgatcaggggattcttacacttcagatcagaagtgactgctcttggtggctgttgatcactgggagagtcaagagtcatcagtaaacctgagacttgtccatcccctggttctggtgcctgttgaggtgtctgtctcctgctttcccaggagccagttcagtcctgtggccacctcattgatatagaaggtcacggggctgccggctgggctctgctcagggttcgtgtcatttctttcttcagcttttgtttagaaagcatattttccttgagcaatgtctgtcaatttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcgggtcactgaaacctctgcctcccaggttcaagcaattctcctgcctcagcctcccaagtagctgggactacaggcatgtgccaccatgcccaactaatttttgtattttagtagagacggggtttcaccatgttggccagggctggtcttgaactcctgacctcaagtgatttagccgcctcagcctcccaaagtgctgggattacaggcgtgagccactgtgactggcctaataaaattaagatttctcttcattaaaagacactataaataaagtcaagccatagtgctggctttggcagcacatatactaaaattggaatgatacagagaagattagcatggcccctgcacaaggatgacatgcaaattcatgaagcagttccgtatttttaaaacacatgcacacatatgtttattgcagcactatttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatcaatattacgagacaggaacccaattaaaaaaatgacaccaccaggcgcagtggttcatgcctgtaatcccagcactttgggaggctgatgtggaaggatcatttgaggccaggagtttgagagcagactggggaacatagcgagacccccagctcctgaaaaaataaaaaaattagctgggcatggtggcatgtgcctataatcctagctactctggaggctgaggtgggaggattgcttgagcccagggggtcgaggctgcagtgagccatgatggcaccactatactccagcctgggcaacagaacgagactccatctcttgaaaacacacacacacacacacacacacacacacacacacacacacaaaacaatgacaagaaggcacaatttggcatttcacggaagagaaaacaagtggcctctcagcatatgaaaagatgccaaacctttctaatcaggataaggggcataaagaccatagtccttggttggtagaaattaagatgactgataactgtaagtgttggtgagagtgtggtttcatagaaattcttgtgctgctagtggaagtatttgttgttacctctgctttggagagcagtttggcactcatttacaaaactggcctttcgtacaacctacacaccagcgactcctctctgctctttagatgtagagtccagagcaaggactggtaaactctttctgttacgggcaagagagtaaatatcctaggctttgtggactacatacacacttagtctttgtttttataacacttaaaaaatctaaaaagcattcttagttcaaagaccttacaaaaataggctgctggctggatttgatttgcaggctgtagtttgccaattcctggttctctgatctaggggacgcatcctggagaaacttagttacatgcagtcttagtggcaggagggccaggggaaaagcacagagcggtatgggggagttgagagagactgggagggtggcctcctggagaaggtcgggggctggactgcatgtgtctgggtaggctcagccatggcctggctgggtgggcctaggggaacgtagagcttctgaggcacaataggccagtgtggagagcagagtggcaggcagggctgggggctgcaggtcgaggctggtcaacccttttacctggcgggcaaggctagtaccaggtgcccttgctacttagcttggaaagattagtgagcatcataatggaccggcaagtttgtaagcaaatgacatctataatacatatactttaacattaatgttttgaaaactttgttttcacaaataagtaatttcccacattttgccacagttatgttctatgaagctaacccaagtgtggctagaacgccagttcatccatctctcaaattgtctgctgccggcgttcattcctgtttgcttctagctgtaaagtcaggctaggagtctgtcagctcatgtgcctgtcagcttcatgcaggcagcaagaacggggctcggaagcaagggctccgcccgcccacccagcaactacctccccaggatgcccaggagctcaggggtggaaggaatttggctcttatttttctaagtagcaaaaatagatgaattgggtacaggaacgcagtgtatttttgagggagctggtgagttgtgaaagaaacttcctctgttcacctgaggcttaccgtatcgtgagaaaggatggaggaggcatggaggtgggaaactctacacaagaaaaatcctatagtgcagcagctactgatgtgaggcggctggtctaggcagcggtgttccctgaggctcctgagtctggttctcactgggtccctcacctcccttcacagccactcccttccttaccaaggtacatgggagtacagggctggccaggggctgttgacagtgggggagtggtgcaggctgagccttagagacaggaagggcatctgtgctggagctgccctgcagaagcctcgtaaaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaacaggcaggagtttcttagaaataacctttggactaagatgttgtagatcgtgttgttagaaagagtgagagggagctgggcatggtgccttatgcctgggatcccaggactttgggaggctgaggcaggtggatcacttgggctcaggagttcgagaccagagtgggcagcatatggagaccccatctctacaaaaatgaaaattaaaaagttacctgggcttggaggcatgcgcctgtagttcaagccactcaggaggctgaggtgagaggatcgcttgagcccaggagtttaagggtgtagtgaagccatgattgcaccagtgcgctccagcctgggtgacagagtgaaacccaccctgtctctttttgagacagagtctcactctcttgcccaggctggagtacaatggcgtgatctcagctcactgcaacctcctcctcccgggttcaagcgattcccctgcctcagcctcccgagtagctgggactacaggcatgtgccaccacacccggttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcatggctcactgcatcctctacctgccaggctaaagcagtcctcttgcctcagcctcctgagtagctgagactgcaggcgcatatgctgccttgcccagctaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttacaaatcattccccaaatatggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaatgctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagatattccgttccacaggccttccgctcaattcatagataatccgttccacaggccttccctcaactcatagataatccgttccacaggccttccgctcagctcacagataatccgttccacaagccttccgctcaattcgtagataatccattccacaggccttccgctcagttcatagataatccgttccacaggacttctgctcagttcgtagataatccgttccacaggccttccctcaactcatagataatctgttccacagtccttccgctcaattcatagataatccgttccacaggccttccctcaactcatagataatccattccacaggccttccactcaattcatagataatccgttccacaggccttaggctcaattcatagataatccgttccacagaccttgtgctcgattcatagataatctgttccacaggccttccctcaactcatagataatccgttccacaggccttccgctcatctcgtagataatccgttccacaggccttccgctcagctcatagataatccgttccacaggccctcccccaactcatagataatccattccacaggccttccgctcagctcatagataatccattccacaggccttccgctcagctcatagataatctgttccacaggccttctgctcagtttgtagataatccattccacaggccttccgctcaattcatagataatccgttccacaggccttccgctcagctcatagataatccattccacaggacttctgcttagctcatagataatccattccacaggccttccgctcaactcatagataatccgttccacaggccttccgctcagctcatagataatccattccacaggacttctgctcagctcatagataatccattccacaggccttccgctcagctcataatctgttccacaggccttccgctcagctcatagataatccgttccacaggccttccgctcagctcatagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggactaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaaaggtaaaatttttatcttgtcctagggaattgcctcaaaatgttgatagattgcctggtcttattacagctctgtgacataaccatcacttacaacaggctaatttgtcctacagcattgaaatgcagctgtttatcttggagagagacagcttctcatacttcggttactttggcacagttttgcattgtgtgtttctgtgggggtgagtgtgtgaatgtgggtgagtgtgtgggggtaagtgtgtgtgggggtgagtgtgaatgtgggtgagtgtgtgggggtgtgtgaatgtgggtgtgtgtgtatgggtgagtgggtgaattaaagaggaaagcagagatgttgggggtggaggacacacttagaaaacaatgcatttgttgaacaaacacctattgggtacctactgtgcgccgggcagtattccaggagctggggactcagtggtgaggctcctctagtgggaaaaaatactaacaaatgtgtaacatcgggtagtgatcagttccatgaataaaaatcaggtggcatcaagggaagagaggtgatcagcactggcttgtctgaggcagccaagggacagtgggggagcatgtggaccctaagctggaactggcagggctgtggggttcaggagctgtgtggaacacaggtcagatgtgagggcagtggggcagccagagggtgaggggaaaggcactgggcagcccagaactgggagggtgagaggggccccggggcaaggcctggtgttgctggggtgggggaaggttgtactggggtgtgcctgagggtggagcggtaggattggccagcaggtggggtatgaggtaaaggtgactcccagtgcttgtggagaacctaggtgtcctgccgagggggtgcccagtgagtggagggtgatgggcttgggggagaatggggagtggagccatgcaggctgcagatgggggtgagtttggtggctcgcaggatcatggggctggagcgagtggagaggaggacagagctcgtgggggcctgggcacaccctcagaggctgcctagaggctggggtgggcttggccatgaagtgactgaagggaggcaccagggcagctcagccagggcgtgggccatcatccagttcctggtagatattgtggaatggtttgttttgtttgagagagagtctcactctgtcatccaggcctggaatgcggtgacacaatctcagctcactgcagcctctttctcccaggttcaagtgatcctcccacctcaggaaccataggtgcatgctaccatgcctggctaatttttgtattttttgtagagacagggtcttgccatgttgcccagtctggtctcaaaactcctgggcttaagccatctgcccacctcagcctcccaaagtggtgggattataggcgtgagccatcgcacccagccgtggagctctaatgaccaaaatttagggagagtttcttttgcttttttctctatgaaatgagttgtagtcctcttaggttggtgcaaaagtaattgcgttttttgccattaaaagtaatggcaaaaacggcaattacttttgcaccaactaaatactttataatctctgaatttgccttgctttctgtaattttcctgtgtccatgtctttcttccattgtgaaatctttttcttgtgtggtacttcagatgtttccagttattaagaactcttgaggctgggtgtggtagctcacacctgtgtgcccagcactttgggaggctgaaacaggaggatcacttgagctttggaattggagaccagcatgggcaacatagcaagactctgcctctacgaaaaataaaaatttagccgggtgtgctgaagcatacctgtagttctagctactagggaggccaaggtaggaagattacttgagccagggagtttgagactggtagtgagccataattgcaccactgcactcagcctgggtgacagagtgagaccctgtctcaaaaaaaagaacttttaagaactgtgccctcccctttggaaaatagcagtagtgtttttttggagtcaagtaattcctccaggctgtgcataatggctcatgcctataatcccagaactctggaaggccaaagcaggaggattgcttgaggccaggagttcaaaaccagcctgggcaacaaagtgagaccccatctctagaacgaaaataataatttctccagttgttaaatttcagtgaatgagacacatgcctaattaacaagacttcaggctttacatatgttaatatgttgccatctcatgccagtcagaatggcgattattaaaaagtcaaaaaacaacagatgctggcaaggttgcagagaaaaaggaatgcttttacactgttggtgggagtgtaaattagttcaaccattgtggaagacagtgtgacgattcctcaaagatctagaggcagaaataacatttgaccaagcagtcctattactgggtatatacccaaaggaatataaatcattctattataaggatacatgcacatgtatgttcattgaagcagtattgacaatagcaaagacatggaatcaacctaaatgcccatcagtgatagactggataaagaaaatgtggtacatctataccatggaatactgtgtatccataaaaaggaaggagattggctgggcgccgtggcttacgcctataatcgcagcactttgggaggccgaggtgggcagatcacctgaggttggaagttcgagaccagcctgacgaaaatggagaaaccccatctctattaaaaaaacaaaatgagccgggtgtggtggcaggtgcctgtaatcgcaggtgcctgtaatcccagctacctgggaggctgaggcaggagaatcgcttgaactcaggaggcgtaggttgcagtgacccaagatcatgcactccagcctggtcaacaagagcgaaactccgtctcaaaaaaaaagatctgccggtcacggtgactcacacctctaatcccagcacttttgggaggccaaagcgggtggatcacctgaggtcaggagttcaagaccagcctggccaacatggtaaaaccccatctctacttaaaatacaaaaattagctgggcatggtaacacatgcctgtaatcccagctactcgggagactgagacaggagaatcacttggacccgggaagtggaggttgcagtgagccaagattgtgccactgcacttcagcctgggcgacagagcaagactccgtctcaacaacaaaaacaaaaaaaaaaaaaaagaaaaaaaggaaggagatcatctactttgcagggacgtggatggagctggaagtcattgtccttagcaaactaacacaggaacagaaaaacaccacatgttctcacttataagagagagctgaacaatgagaacacatagacacatttaggggatcaacacacgcaggggcctgtggggttaggagagggagagcatcaggaagaatagctaatggatgcggggcttaataatacctaggtggtgggttgatctgtgcagcaaaccaccatggcacacatttacctgtgtaacaaacccacgcatcttgcacatgtaccctggaacttaaaataaataaatatatagctatcaaagttatattttgcttcttgccaaaatcagttacctttatttgcagaatagaatccaacaactgatttttgtttaagaaggaatcgtagcgtatgtctgttaaacaccatataagtaactgactctgaacaccagatgaggctgtaacaggtcaggtttaagcacaagcatatagattcacgaaatggcgtcagaccctgccctggttgcttaggatgcacaggagaataaattgcactctctccttcagtttgcagtctgatgagagagacagccagatgtacagtttaattcatgttagtatgggaagtactgggactgtaatattaataacatgccaacaaggaaggaccagttacaatagcttagccggagtgtcaaggaaggctttagtgaggaggttgcctttcatttgatctgggccttgaatttgtcaactaaagacaagggagaaagagaatagatggaaagcacagaatgataatgagtttggggcctgatttgtgcaaacattccttataaattgcacttcatgcttgagatgaaacaagttgaaaaccgtttgagcagtgttgacagtagagtgcattttaaggtgtgtgtcagcttctctcagggcctgcagacatttcagcaagcacgcgtgtttggggtcctgccagtgcatctgcccctgcctctcagcctgaccaggggagagcagttgctggttggctgcctttgctccaggcctggttctgtgacttgcccttgccctaggccacctctcttttcagtgatgtgatttaattcccatgtattttgttttttttttttttcaatttgaacacccttattctcatcccctgaggccttcgttgagtttatttctaggaagaacagtcctgatgtagggagacctaaagcccaggtcattctaattctcctacactccctgtgttctgtggtgtgtcacaacatcaagtgttgataaaatgtgctgaggatgcatggaaaccctggaccattgcagttcatataaggatttcttttctacgtttaaactgtggtgtagacagtatgccagctattttcaggttttattattactttttaaatttataggttagcataatttaaagtgtcaggaaacaaaccttttagatttaatctagaaattctggaccatcattctttaaacagctctgttaacttgtgaaggtcaggatgataaagatctcaccctatgggaaagcatacgtggtacaagtctgtaggtatgaccgctttggaaatcaactgtcagtatcctactaggttggacattcaggcactcagttaaccagcagttcttctcctggatgtgtaggagaaacacacacgccaggaaatgtggccaggtgtgaccagagccgcagaaatctggaaacagccggagcacccatcagcaggtggaaattatattacagtgttgttatacgacaaggagatgtgtcatacagtagtgaaagttagaggcctgcagttatttgcaataggcagatgagtctaagaagtgtaatactgagcgaagtccagaagactcctatggtagaattctgtattaacaaaattcaaaaacaatcagaatgaaacagtgtttcatttggcacacatatgtatagtgaaacctttttagaggcagaattacaaaactcagggttgtggttttaatgggtactccttgtgggagaatgagggtgagatgggagaggtaggtgcagaagatggatgttatcagtcatgctcttggacctgggtgttggcttcatgggtgttcactatgtagttatgctttttttttctttctttcttttttttcgaggcagtgtctcactctgccgcccaggctggagtgcaatggcacgatcttggctcactgtaaccttcgcctcccaggttcaagcaattttcctgcctcagcctcacgagtagctgggattacgggtgcccgccaccgcacctggctgatttttatattttcagtagcgacggggtttcaccatgttggccaggctggtttcaaactcctgcccccaggtaatccgcctgtctcggcctcccaaagtgctgggcttccgcacccggcctgtgcttttcaactcacacatgtgtgcacatatatgtttgtgtgatcagaattacatttaatttcatagataggactgatttcattaatagacaaatgaaaaaaaatcagcagcagattcagggttttttaaaaaatgaatgtgttattttcctttggcttctgtaacaaagtaacccaaagttggtggcttgcaaaaaacaaatttatcctgtcatagttctgggtctggaaatgcaaaaccaaggccctgctgtctcttgacaactgtagggaaggcttccctgcccctctcagtttctggagccaccagcagtccttggccttccttggctcatggctgcaccactccaacctctgccctccatgttcacgtggccgtcttcctagtgcatgtcctcacctcttctaagggtggcagtctttagatttagggtctgcccgacgccagggtgtcttcgtcttaactgacgccatcttcagaaatcttatttccaaataaggtcacattctgaggttccagatagacatgaattttggaggacattattgaactcactgtagtagtcaaaagctgtgaaaatgccttttcacaggaaaagaaatagaaatgattaatagagaaatagaaatgattaatatcaaaaatatgcttaagactgggtgcagtggctcacacctgtaatcccagcactttgggaggccgaggcaggtggatcatttgaggtcaggagttcgagaccagcctggccaacatggtgaaacccctcctctactaaaaatacaaaaaattagctgggcacggtgatgtgttgcctgtagtcccagctcctccggaggctgaggcaggagaattgcttgaacccaggaggcggaggttgctgtgagccaagattgcaccactgcacttcaacttgggcgacagagtgagactccgtctcaaaaaaaaaaaaagaaaaagcacatatatatgtgcttaaccacacattactaaagaattgcaggtcccactcaccccatttttttacctatcagattgccaaagattgtgcgatagaattggtgaggatgtggaaacgtgcatcccctgatactgggagtggagactggtgtgggcttgttgaaagtcgaacacagaaagttactgagtggccttctcttccctggccacagtgctgccctccactcccttctttctcagcctccctgccctgagccccatccctattctgccgcaaaaccactgtgggtgcctgcagagttgggccttagaaacatgccgaggaaagcaagctcctgggggagaggagcaaccacgttccgaggacgagcttccctcgggtgggccgctgccctcctcagccctcagacccgccagtcagactctggctctcagcaaatccctccccagttccttcagcagaacagcaacataactggaggccaaaagaggacctgaaaagatggatgggggaggattgaggcatcctgtggccactgggaaaccgctgccacagtcttctgctcagcagggactgttcagcgtggctccatctctggctcttcctcatcagtctctccccaggggccctgcagttgatgtccttgtggggagtccttgcccttgctctgctcatggacaggcacccagcaggtgcccatgggatagggcttaatagtcgccatcatccagccttagcaaaggtgaagtttgtgctattagggaaggcctaacccaaaacctatcccaattttctatggactaaagataatgtagattaaggttctaggttagtaatgtaaatactcagtaggttatgctgctctgacatacttgggaagcatcatttccagactccaaactaagaggccaagggaaaccctccgtctctcaaccagcagaggcagacaccagctgggtccccagctccactgtccacctgtgctgtgagtgctgtgtgagtggccatgcctgcctgagcattgcacgataggggctgtgtgaaccaggagcagctctggcacagaggaggcgtgctaaggggaaacccttgtggcgaggcccccaccagcagactgttctgaggcaagccgccctcactggtcagatctgaccagatctttggagatacctgtggcatcctgagacactcacactccgtgacaataatgactcagccatacgtaatgtgagtgccataacttagaggacagcgatggtgagcagagccattcctgggggccccatggggatctcagcgggactgaaggaagacaggttgtgtgtttaaagttgatagtactttctctctctgtagaaacacgaagacaccgactgtccctgcgtggtggtgtcctgccctcacaagtgcagcgtccagactctcctgaggagcgaggtaggggcggccgggcccggccgggagtctgtggagtcctcagggctgcgtgcctggctccccttccctgcatagccgaagcctcacgttttcccagttcgtgagagtcatgtgtatggcagacaaacaaaaaccacagcaaaaagccttatgccattttttggaagtcagaagcaagcattagggttaaaagctacagtgtatggccgggcacagtggctcacacctgtaatcccagcacttttggaggcctaggcagatggatcacctgaggtcaggagttcagaaccagactggccaatgtgctgaaaccccgtctctactaaaagtacaaaaactagccaggtgtggtggcgcgcacctgtaatcccagctattcaggaggccgaggcaggagaatcatttgaaccggggaggcggaggttgaacagagccgagatcacaccactgcactccagcctgggcaacaagagttaaactccgtctcaaaaacaaaacaaaacaaaactacactgtggtaaattcagagcaaagattgtgaagcattaagaaaatgggaatattttacatacagtacaagcaaaggtgacgaggggtttttaaagcaattttaactctatagaatagtaattgctgtaagattatctcaagaacatgaattaacttagagacacttcagaaccattttgctcacacatgccgggtggaggacagctcccacattttagggctgccagaagggcccctgtgtggcctctcccaaaggttgcacgtctcacattgcgcttggcactctttctttgagacaggtagattttgcattgacttcacttgatcaggatatgtccagttgggaaaatttcaaggattcttaatgtttctgcatctgtcctgacggggagctcctttagttagtattctgggagtcatctggggctaccctgggctccctggatgtgtggtacgctgatctaaggagccggctcaccttttcacctcagcatttttcaacagcctgaaattttaccactggatactgggtaacagggagaaccagcctcgcatgcccctgactgagcaagagggcccatgtggggctagggccagggactcagggtagaggagggcccagagagccactctcccccagggtgtgccctcccagcaccttgaagctgatgggtgagggcaaagtcttgcctgatgacagtggcctctgggccctgaatctgcccctgggaggagctagggaaaaataaatgtaaattattgccacaactggacaatcctctgttaatgtataaagagtctgtgctgttgaaataatttctttttttttttttgagacggagtctcgctctgtcactcaggctggagtgcagtggcgtgatctcggctcagtgcatgctctgcctcctgggttcacaccattctcctgcctcagcctcccgagtagctgggactacaggcgcctgccaccacgcccggctaatttcttgtattttttagtagagacggggtttcaccttgttagccagcatggtctccgtctcctgacctcgtgatttgcccgcctcggcctcctaaggtgctaggattacaggtgtgagccaccgcgcccggccaataatttcttatttaaaacattgttaaacctgcatttctgttgggtttctgatgaaaggtgcttttgagctatagattattcttgcccctattccagagatcctgtagattccccgagactcagaatactgataataaaaccaatttagaaaaagacccaacaccgaatttactctagtacactgaaaataacatacatcaaacccagtgtgtcagtgtgtccctggcttaacatgtaatagcgttgacactcaggtttgttattgcagtaatgacactggaagaatacattccaagtttttaaatgaacctggttctgcgcagtcttcacactgcgtttccttgccagtcacctgtcacgtgccttgtgggcgcttcctgcaggggcagccggtctgggttctgaggagcagcaagggcgtcaggctgccaggttcctaccaccttgactctgccctggctctgagaccttccttgaaggttgaccctagcagtggccgcatgggcccctcagtcccttcccgcagtgtccctcctccttagtttcgcagcagggatccattttcccctctgttgtaaatatccacctagagggaaggaccgcctttgtcctggtagactgagaagttgtagaacttagctgcgccctccaggaggatgtgctctatgagccttgggaacacatgcatgctggcacacagaagaacacattcccggctgctgcacccacacacccatcctcccaaaaagagtctgttttctgtgaagaagatctatccctagagtttcctgatgggaatttcttcaataaaagacaaaacttctgctcagtcttggggcatgataaagaaaaagaccaaactatacctcatttgtattagcctaacacatgactctaagtccttaaaatgtaatcctttccattcccttttctcttgttagggcatcataagtaatttttatttgataactcaccagcatttgagctgagcaagggacttttttcttgcaaaacgagttacctgctcccagccccacctaattttcctgccatcaattagagttgacagtagtaagagtgtatggttagactgatcttagaggtctttgaaaagctacctgagtttctggcccttacagagggaaaaagtcttttcagatgaaggaaaaactcatctgcacttatctcaagtattatgagtaatggtacattgtgtaagcttgctttgaaaatatatttatttttgtgtaccgtatattaggtgtgtgacccagttgcattctgaatgctttctatttttttgtgttttcatgcaatttttgtttatggtctttaaatgtgcatttcagtttatgttttttctttcttttttaaattctggcactacagatggcatgtcacattgaacaatttgttctaaagaaactggaagtttaagaaatgttatagtaaatgtattcttgtatattggcgtatatgtgtatacacgtgactagaccgtatatttactgcatagaagtctaggcagcagatgatatatacacacctgtagcgataaacaccattcttaatagtacagctcagatgctatctgtgccctaatatgtttgaacattttcatgcaaacgtttgtgccacaactcacgtctctttcccgttgcagttgagtgcacacttgtcagagtgtgtcaatgcccccagcacctgtagttttaagcgctatggctgcgtttttcaggtcagtatccgacatttgtccttcccagtcactgacattctgccatgagagaaagttattatattaacattttaacatgcaagctctggactccttattctttgtcatgaaactgaaacaccctgttgcatgggtgacgaaagccacatgcagcaggtgggatgctcgctttccagttggtggtgctttgagacttcagggagacactgtgctgaggtggaagttaatacattaagagaagtactacatccaaaaccagctagtaatgcaacaggtagacttgacatttggtggggttttcagatagattgttacggaaattttagcagttacctgaatataagcgaatatcaaactgagcatagtttcaacagcgtgtgtgtcagtacacagccataacgatcacacacgtgtgtatccataaatgcatttgatgtacatgtctgtgctgactctgaccccaacgggggacagacgcaaaatggagcacagctcatagagagcacacctccccgagaacagtgtggggagggcatctctgttgctgccgcacatgtagtgtgagaaatctgcatctggtgttttgttgttgtttattttttaacacatctgagattgctagtgaattggaactgagttttcatttaaatatatgtatcttaaaactatcaagaggcagtatatgttacaattaaagtattttatattttatgtagcaccaatacattattatgaagtcagtacagagagattggcatcttagtattttctgaggaagagaacagccaaagagtaagaatgactgtgccttcctttgctttagtctctaacaagactgagcctcccctgttctgtcgtacgtagtatcattcattctctctgtgtatgtgtatatatatgtttatatattgcaacacttatatcaacatatatatatgaatattctatgtacagagtatatgttttggagatcattaaaatgctttctgtggcttcttaattttctaatagcaaaacaaattatatttcagacaaattattttcttaaatatatgaagtacaatttcatgtgcttattcctgactctaaaatggtctacatcttatgtactctgtagattgtatttgttttgtatgtaacttttctaagaatactggaatggtgaagagcaatacatctttggatacagtgtatttgaactaatacattaatactttagtaaattcttttgaatcctgctttgcttacgtgtttactagactgttgtggcagtatctcgctacaactacaggtatctaaacattttccacttatgctatattttaatgggaaaaatagcttataataggtcaagaatgagtttaaaatttaatttcttgatattacaagtgtcaacccttgataagaagccacttgagatgagctgaagggatgcggagataaccctgagatgctcactgtggcactgcagggtgctggctctgctgctcctggcggcctcctcacctgcacgcagtagccaggtggccctgagcacagccctccttaggcgcagagattccctgttcacttgacgcaaataggtctcccctctttgtgtttagtgctgcttttagggtcgtatgttagccgttctgccctttgaaatgcagcgaggttcgctgaatgcctcacatgtttgctctcgcaggggacaaaccagcagatcaaggcccacgaggccagctccgccgtgcagcacgtcaacctgctgaaggagtggagcaactcgctcgaaaagaaggtgggctgcacactttcctgctgctatgggatttgtatcatctcttcagattatttaaagacaaaacctttttgtagttattaatgggttttggataaaagaaactatcaagagaatgtcaaaaaaaactctgtgtgatcttgagcttataaatgaaggtgttttatttttgttatttgttttttaattgccaagcaagtgtgaagtgcttttttaaagtcaatcacattgtgattattttagcatccatccagcacagagatgatcagatgcccagtccccaccctgctgttttttttttgtaaacaaagttttattggaagacagccatccttactcactctgtgttgtctgtggcttcttttgctcgaaagcagcagagttaagagacatgtggactgtaccgcttgagatactgactacttggctctttacagaataagtttgccagcccggacctgggtggttacccctctaaatgcgttaaacttctgtgttttttacaagagacaaacaggaaaaaatatttgatatgattacaattgattttgtcatttgacaccttgtgaaacttggtgcgctctccacatagacagggccacttcccaaagagactctcccatgctgttctttttttttttttttttttttccccaagacggagttttgctcttgtagcccaggctggaatgcagtggtgcgatcttggctcactgcaacacctctgcctccctggttcaagcaattctcctgcctcagcctcccgagtagctggtattacaggtgcgcaccaccacacccagctaatttttgtatttttagtagagatggggtttctccatgttggtcaggctggtctcaaactcccgacctcaggtgatctgcccacctcggcctcccaaagtgctgggatgacaggcgtgagccaccacgcccagcctccatgctgttcttaagaggccttcattgcaggcctataggcgcaggagcaagcaccttcctccagtaatgctggttctcagtggagtttgttctgtgatgttcagctcagtggggccttcttttcatgagaagatgaaaacctctaagaatggatagagaagaagttgttataggatctaccattgtggcttaattacaaaaatataaacttaattcaatattcaacaaacgtctattgagaacttgtagtaggaggatactatggtgaattagaacagccagtggagttgacatttgagtttcgtaaagatttgaatgtcttgtttccagtgttaaatcccagcaatttaaaatgtaaatatactgcaaggagtctaaaattttaaatagaaagatttccctttaatctgccataagagagtgtttcatgtaaatgcgtgagctgagcttgagaagcagcaggaggatcggcatcctgtgcacacacacggagcagaacagcgctgatgagcagcagtgccggactcatattcgcagaatcctagccatcttcccgtgagcatagagcatctgctctgagttcaacaatggtttacctaggaatcttttttttccctctttttgaagctggcattttatttctgtctttttaaaattataggcatagatcacaggctttttatctttcatagatgctgtgtttctcatttagaaggttcttcctttcattttaaggataggctttgtggccgggcatggtggctcatgcctgtaatcccagcactttgggaggccgaggctgaggctgaggtcgggagttcaagaccaagctggccaacatggtgaaaccccgtctctaccaaaaaaaaaaaatacaaaaattacgccagcatagtggcaggcgcctatagtcccagctacttgggaggctgaggcaggagagttgcttgaacccgagaggtggagtttgcagtgagccaagatcgcgccactgcactccagcctgggcgacagaatgagactgtctcaaaaaaaaaaaaaaaaaggaatgggctttgttactgctgtgttagatacacagtagttgaacaggtctgcagcacatggttatccagcaggatggttgtggaccgtggtgtcatctggcagcctttcggggcctaatccctgtggggatttggctccttccttcctgttctgtgctcttttccccactgaaagtgaatggtttgcatcattggaaaccccaggacataccagagcagcctgcccacacacagtgcagcagtttctcactctgtcaatgcctcatgtgtttaaactatctccagccaagtcacgatggaagccccgagagtgcaggatgcataactgtgcacttccctcttggacgttgccaaaggactgatctctcccggactctgtccatcagagcagagtcctcgccctgttgtcaggccagccagctcggctctgcacgttctcattgtgctcacgagaaggtgtatggtgccctttgctaggtccaaaagcaaaggctggacaaacagcagagatatttatgtttacttaaaatgggaatttatttcttattatagaattatttagttggaatttcttaggttattttgttcatctgtcttagaaaatagaatgtttgagcgggttcacaaagactgatcctcagctgggcgcggtggctcatgcctgtaatcctagcactttgggaggccgaggcgggcagattgcctgagctcgggagttcgagaccagcctgggcaacacggtgaaaccccgtctctactaaaatacaaaaaattagctaggagtggtggtgtgcgcctgtgatcccagctactcgggaggctgaggcaagagaatggcgtgaacccgggaggcagaggttgcagtgagccaagatcatgccactgcattccagcctgggtgacagagtgagactcgtctccaaaaaaaaagactgatcctcacattcatagtcaaactaaagaaaaactgcaaaatctggacttaaaaacacccattttatattttaagagagcttaaatggaggggaaatgtaaagcccaccaaagtgggctggagtaaaggatgttctcattgcagagaacctcggacctcctgggccggtgttttgccggctccttggaacacacctgccaggtggactttcctgtgcctatggcatctccctgctagaagagtggaagcagtgatctgcaggacctgggagttggattcttcgattaaataaataaataagtagtttaaataagggaagtcctaaagtgaaagaagttgagtttagtgtggcatgatgtgtgttcattgctgtaagctgcttctgctcatactcaactgcttgatttgttggagagcagtggcgcaattatggctcactgcagcctcgacctcctgggctcaagtgatcccatccagcctccccagtagctgggactgtaggcgtttgcaccacacctggctaatttttgtgtttttttgtagagatggagtttcgccatgttgttatccaggctggtcttcaattccttgggctcaagtggtccgtctgcctcagccttccaaagtgctgagactacacgtatgagccatcacagctggcctattgacaatgttttggagacattactgagattttttcaaaagagttggcatacatgtcatctttttgcagggatatgagaataaagagtctgagaattctgtcccgtctttgacagatggaaatgaatgaattgttactttcagagggacacaactaccacgcgatgctgcatatggcccgctccacattcgtgcaggttgatcacttgtaggagttcatggacgtatgaggcaaggaaggaaggaaagcctttgcggagtaaaatcctaggaaagtgaagttatattttgcccatgagacattgcaagttttgtattccttagtaaatacatacttgttttaaaataagacggtgattgcttcaaaagatgtctcttgacttggccaactgtgccgaatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcttctggggtggagaccaccaccccaatggatagacagagacactcgttaatagatgggggatcaagatgccctttgtaaaaatcttgtgagaaagaaaccctcgttggagttacccttgaacttttcatctttgagaccaggtgttaatttgtctttgggagctaattatctttcagaaagattttggaaaggtcaaatgtggggttggaaatgctcactcagcaagccctccctttggctgatgtgggttgcaggggctcttctgcgcttccgtggaagggtatcctcaggcatcagctctgcctctccgtgttgagggtgagcaggctggccccaagggtgtagcacccatgtaattttttgtattctcgtcacgctctcattatgttggcagagctgttcaaactgcagggtgtggcccctgggtggatgtgaaataatttagtaggttgtgaccagcattgtttatatttatggggtacagtgtaatgttttggtatatacacacacacattgcggaataattaaatcgagctaattaacatatccatcacatcactttgtttaaaatctgctcccccagcagtcttgaaacacacgttagtatgaatcacagtcaccatgctgttcagtgggctcaaaaacgtccgcccctctgtctaactgaggctctgtgccctttgcccagcagctccacaagcctacccccactacccacctccaccagcccgggtaaccaccattccctgcttctgtgagcttgacttttttagatcccacgtctaaatgagagtgcatcgtgtttgcctttctgtgcctggcttatttcagttagcataacatcctccagggactagtattttcttaaatgaaatggaataaaaaaaatcagggtgcattgtaaattattagggcaagtacagctttatgacatctgttttcagggatacacacacacgttggtataagtggggtgatacataagcatctgtttcttactatgttacctggtcaacaattgaaaaatactctgataaaagatttgctagtttttagcaaaaacttgaaaaagcatctgatttattctgaaattcaatcagccgctgcactttgcctcaccctaattactggaagagattctgagaaacactgtttatagcattccctattaaattaggactggctgggtatggtgactcacacctctaatcccaactctttgagaggctgaggtagtaggatcactttaggccaggagtttgagaccagcctgggcaacatagcaagaccctatctctaaaaaaattatttttttaaagcctaaccagacatggtggtggcatgtacctgtaggcctagcttactcaagaggctgaagtgggaggatcacttgagcccaggaggtcaaggctgcagtgagctatgattgcaccactgcactccagcctggggacagagcaagaccctgtctctagaggggaaaaaaaagaaagaaagaaaagtaccaggactgtcattttctgtgtgaagggatttttttcttctgaaactctgtcaataagctaacagaaggcctatattgtgaaaatttaattgatattgttgttaattaatatgaaaaccacttttggttacattaattaaagaatttcttttttaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacaggtaagaatcttaggactacggccagatcaaagggtggaggagcttgcctgtgttccccttaagggtttcttagcaaactctttgagctgagtccttgacctttgcaagcagaaaggcaactgatttctctggcctaagtgaaggcttagaaaaggcagctggactagcacaggcccggcctgggaagccgcaggtcagcgttttcaaactgccttttctctggagagcaagcctccacccctcttccatgcctttgatctaccgttggagaaataagatgcgaagcttgtatttgttaaattagctgtttttattatttaagatttcatattgttcatgagtagttgctgtgtgcaaagtctcacttcctgcagtgaggtgctgtgcagcccagctactctgtgtgagctttccagtgacacgcgctcacccgctgggtttcactgtggaaatccacacgcacctccagaagaacaaaccagtgaacctttgctcccctgaatagaggcgatgatgtaaaggggactgatgaaatgtcgcttctcctgtcttctgtcgtcacaggtgtctgtggggtgcttgttaatagatgatcattgtagatgctctctgcacattcacttactcgtgtgcatttgtgatagcacttcccatgggtgtgtcacacaccgtggaagaatcactcatgtcactgaagggcctgaacttagacggtgtgtccctagattatctggaagagaaactacttctaatagcacagagtcatggcatctttgagaatgccttttctccaatttttgacattggagatgagtcatagtgacttgaattgcgtagggatttattaaattaatttcatttttattatattttgtagttatccagagagagaaggagaaaacacaatgaaacattagattgtattagaaaaggcacaagtcattagcattaaatcaagccaaataaagtacaatgtttcttaaaacaccaagcctcccgctggaagcccctagcattttgctgagggcccagtgatgtgtcagtcatcagactggccaaggcgactggtcaggccactgctgcggggccctggccatcctgtggcccgcctgcacctgcgctccctggcaagcagctctggctgttcatgagattattgctgtgttttgacctggggctcagagaggcactggaaaggccggggaaatcacctcttaaaatagccacaacagaaggaagaatgcacaagtactggattcatttacaacaaaaagttagaatatacacagtgatgtaccaacgccccatcccaaacctcacatttcctctgcattcatcttcagtttctccccttccagtcaggtgttgtcatttactttcctttttagtcgagtttaatcactctatggtatgtgatttctacttgaaaacttttgtgattggatgaaccaatgaagcataagtcagaaagaaagggggaagccaagttgccaagggcagagaagtgaggatggagtggtgacggcagcggtcagtgtcccttgacctgtgacgagtagaaggtgatggcgcacctgcctcttccccacaggaggctgggcgtggcggagagcaggttgtgtttagggaagggactcagagcaggctgcccgcgcctgattcccctgagtgcagggacacggctctgcctgaaacatgtgaaaactcttctccatgtgacctgttgagcaggcgtggtctacacagaaggtccttccaaccgtgtggttttttgaaaggggaaattcagtgttacctttgggaccactgtggggttggtggtctttggccaggaggattctgcactgtccatcctcaggaaatgctgattgaaagccttctgatgcccagaggtgctggctgtgtgggagctgcacggggccaggccatccctctgctgctgcaggccccgcctaccctcttgagcagcagcccagctcagccgtgttccccactgtttcatcctcagagcccttcctgttgccccaggaagggtttatcgtaaaatcttactgtggcccagaaaacctctgtgcctggccaccggtcaccttcccagcttcgccccactccctgcgctaaagtggacccgctcattgttccttgacaagctccatgctgctgcacagatgtctttttctcctgcttcccttcctggccagctccaggcactcctccagccatgtttgtggaccagctaggtgatgagggcacacgtcacttggggtcttcttctttcttccttgtctgattctccagtagaccctaaagccctggtgatggcgggagtcgaagcacagagggcccgatggcctggctgtggcagtgggggtgcaggcagggggtcaaggagtggaattcaagagtgtctttgcttttttgcctgtccggggaacgatgagttcttaatattttacttcttaaatatcctgtttttctttattaagaagacagccaggccggatgcagtggctcacatctgtaatcccagcactttgggaggccgaggcgggcggatcatgaggtcaggagatcgagaccatcctggctaacacggtgaaaccccgtctctactaaaaatacaaaaaattagccaggtgcggtggtgggcgcctgtagtcccagctactcgggaggctgaggcaggagaatggtgtgaacccgggaggcggaacttgcagtgagccgagatagcgccgctgcagtcaggcgtgggagaaagagcaagactccgtctcggaaaaaaaaaaaaaaaaaaaaaaagacagcctaggccggtaggccggacacggtggctcacacccatattcccagcactttggaaggccgaggcgggtggatcacgaggtcaggagttcaagaccagcctggccaagatggcgaaaccccgtctctactaaaaatagaaaaattagctgggcgcagtggcaggcatctgtaatcccagctactcgggaggctgaggcagaagaatcacttgaacccaggcggcagaggttgcagtgagcaaagattgcgccattgcactcgagactgggtgacagagcaagactgtctcaaagaaaaaaaagaagatagcataggtgcgagcatgacccaggcttctggtgtcagtggactagatgaactggtggttcttacagtcagggggtccacagggcacacgtagaggagcacgcactgggacagaaggcagggacgtccatccacgcggccttcactcaggctgccggcaccaccgggcttctcacagcgccgggcttgtgtgccagggtcgcagtggcctgagagtgaggcatcacagcaggtgacacggttgcagccctggcatgcaagtgtataaggctcacgggctgatgctccctgaaggcaaaccttctgatttggattgttgatgtggagtgcagtctgtctcttcagctctgtgtcggagtcttttttctgtacaattccatacctgcacttgagatttattttttatagaaactgcagtgactgagtgtagaccgttcttcaaggatgaaatcacgtttgctgcgttttagagaacacttgatgtgactctgcgttctgctttgaaatggtgccattgatacagatgaagtgcctgttttaaaaatagcccgagttcccttgctgctcatggagacgccttttatttagtcgtgctggtctgtgcatgcggtgcacgcatgttgtgtgttcctgactcgggggcccctgctgtgtgggggagtccttgctggagactccccgttctgtgcttgaggtcaggcgtgcccttgcgtagcacaatcgcggggaggggtggctcggtgccatccccctcttaacctcgggggcctgaggctcagcgtgaggcgcagcttgtcttgggccaccctgcctgggactcatgcttcatttcggggtttgctaagttacaaagggcgtctctcagacctctgttgatcaggttttcattaactttcccctgccactcgcgagcacccctgccagctcagtgtgcgtgttagaaggtggagatgcgagaggcttccggtgctcactagaggagccgtgtatttggatgttcagtgtcgtcagtggtattgtcccccagcaaatagacttggtgagctaattaaatatccttctgaacatgtatgattgtgtaaaataaagggacagtgacagtgtcagtttaaagggacagtgacagtggaaagaggtgttctttagagaaattatccttactttttagaggttaactaatatcatgtttcttggaaagaacaggaagaataacactgcttttacgcccaaaaagccacccagacctgtcatgtttgtgtctttgtggttaataacagccagcaaaggtgctgaaacctagatgtttaaaaatagacttccaaaaggagaagtgaattcagggggccctggggcccgcccctcgagcacccggtgtggccctcagcttgtgaggtggctcagtcattccacagctgcattgagcactgaactctccagccatcacaagctgcttgaaaatgcacatcattttttgaagtgaaaaccctttaagtccctggcttcatctcacaggtggacactccagccccttaacacagactgggccaccagggcggagtacagctcccacccctccaggtagtgacaaatatgagcagcctgtgtgttttgggaaagggctttctgaattagttaaatgaagtagcataaagtcaggcctggttactggcagcctcgtgtgttcgtggcagggtttctgcgttcctgcctccctcgctggggcctggcagcctgagtgtggagctggagggggaagacccctgcgtctgcagcatcggcccactgggtttcacctagggcctgaggacatgccttggggccctttcctgccaccatccaggtgggaggggtctgaggagtgggagtcttctcctgggaccctggggtcgttctggggaaccccctgcagccacagagacaggactgtgcttctgccccagacccagcagcagggtaggaggcctttagacgttccaagggaagatgaggccacatgggcatgattctggcatcctaaacctgagaccctgtggcagccatgcagggccacctgtcccgtgggacctgcacttacaggggtgaggcctctctgggaagcagggaccctctgtattatggcccccgaggtatacgagggctgcagaggagatgtccatgggagccttgtggccccgcacaggtgctgtggcctgggagaagagctgggagggacacatgggagtgtgagggtgaggtcggatcctggtatctgaacaggagagctggtggggttggctgatgccagggtgtgggtgtgtgagaaacaggcgggcaggcggcaccagtgccactgtgaaacagggaagcctgctgtgggcagcagaagcatgagctgctgcctgccccagagacagtggagacctctcccctggtcttctgaacacttgccacctgtcactttgctttcctgatggctctctgttgacaaagcaagctgacttagtggagcctcctgttgttttcttccatgtggcttcatgtcacctcgagtgctccctgccggcacaagcacttgatcccagggagctcccaggaggcctgatgcagagccccactcctggagtcagagccgcgggtggcaggcctcatacaggggcctctgactgttctgctcctagcctgtctgtatttgatggaaggtggtgcagcattttccgagtcctaactgtgttttgctttttaacacctttggtttggaagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggtgaggcaggggccggggccgggccagcagtgtgcatctgggccccgggcgagtgctggggcggggtccgtgggatgagggctatgttaggtacatgtgccttaggacagttttttctaattatgggtaacacgcagaggtgtgatgactttcctactgaaagtcccccagcaaagacaaacgtttcccgcgcaggcttgtcccctccgtgtgaggccctacatggtgtagaaagtaggggcagctgcagccacgggaagctgcaaagccctcctgggagagactggccgcagggtgacccacaggacaggcccaagcgcagatggcagaggccaggacctgctggtcggggcgccccagaccccactcctaagggccagggggcagcagtcccaccgcgctctgccagcatgtttctgatccacaagcagatgtgggcctatggctttggggactgaaagagtattgggaatatttacatgaggaggattaatggcagaaaggaacacagattaccggtgtgtgtgtggggccggatgaagcaggcagagaatgaggttggaggagaggggagcagcttcgcctccaagagagcagaggccacctgtgggtgctgaggccggagggaggagtggggagagcacagctgtctcctgctcccaggagctcccaccagcgggcttcccaggaagccacagtggagcactctgtcttggaccctgcagtgaggtgtcctttgacacacaggcaggtcaaccgcccaggacatcccctgtcagcagtctgtgcctagtaatgtgtccagacagacagggctgtgggcatgagagctgtggtagaactggggcagggacctgggctcttccctgggaggcggtggcctcaggacatcttctacacagttttgctggtgttacccccagaaaccacagtgatttttatattgttgcttcagatgctggtatgactgggcatggtggtgtggcctatagtcccagtgctttgggaggctgaggcaggaggattacttaagctcaggagtttgatgccagcctgagcaacagagcaagaccttgcctctttaaaaattaaaaaatgaggccgggtgcagtggctcacgcctgtaatcccagcactttgggaggctgaggtgggcagatcacgaggtcaggagattgagatcatcctggctaacacggtgaaaccccatctctagtaaaaatacaaaaagttagccgggcatggtggcgggcgcctgtagtcccagctactcgggaggctgaggcaggagaatggtgtgaacccgggaggcggagcttgcagtgagccgagattgtgccactgcactccagcctgggcgacagagcgagactccatctcaaaaaaaaaaaaaaaaaaagagccaggcacggtggctcacgcctgtaatcccagcactttgggagatcgaggcaggtggatcacctgaggtcagaagttcgagaccagcctggccaacatggcgaaaccctgtccctactaaaaatacaaaaattagccaggcgtggtggcaggcacctctaatcccagctgctcaggaggctgagacaggagaatcgcttgaacctgggaggcagaggttgcagtcagctgagatggtgccactgcactccagtctgggcaacagagcgagactccgtctcaaaaaaatgaaataaaataacgagtgctggtgcagctttgctttcctaacctctctgacgttcacctgtctcattcaccaaaccctcctcacctgtggcaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctca

SEQ ID NO: 2227 - DNA, 134023 bp, Homo sapiens; identical to SEQ ID NO: 2226

SEQ ID NO: 2228 - DNA, 134023 bp, Homo sapiens; identical to SEQ ID NO: 2226

SEQ ID NO: 2229 - DNA, 134023 bp, Homo sapiens; identical to SEQ ID NO: 2226

SEQ ID NO: 2230 - DNA, 421179 bp, Homo sapiens
ttttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagtgaaatgagttcagtgatctcattctagtccttcgactcctgtccacatcactaagcgactgcacagcttggcacaggccaggatgagtcagcagtctctggtcatgagaggccaggcctggaatagcaggggggtttaggtcaggagcaaaatgaagcagaaaggcagtctagatggcagggctctgttctgcaatacacagaaatactgcaggtcaaaatgaaagcgcctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttcttccacatgctcccaaacttgaattaagaaatggtgacttcctatatactatcctagtattttggtactgttttcccaattcagtaagtagcaaaacaaataaaatgcaaggcactgcagttaaatagcaagaaaagcctcatatttcataaaataatatgagtctgatatctcaaaggtgtacatttgggttaatagtgtctgtatatagcctgtatgaaatggttaaagaggagtactctttaagttgagcttgggtgggggtagagaagagcttagagaaaagagagttaccagttaatgataaaacataggggaactatgacactgtgaccatatttctactcaatggggccaacatagacctccattagacctccatcaagaagtgatgctcccactaacaggacttcaaacacttctccctctgcagtagtactgtaatatagcaaggggagagggaaaataaaatagatagaaaaacaaggttcaacataaaaaaaattagtgatagacattttgtttcagaggaggcaaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttcagagggtattaagtcatctgaacacatatttactaactgtttaatcttgggcaaatgagctttctagcctcagtttctctctctttgaaatggaaataatattatcatcctcatggaatcattgtaagcactgaatcaatgttcattaacccttatctcagcagtacctgtcacatggtgaacattcagtaaattgcttattattcatattatttgattatcatatcatatcatctttataagtatccagtgaaagaatccccctccagtgttgttccactggattgagaggaatcaatatgaagactctagtaaaatcagttgagtaacactgcttacactgctgctttaaaaagattatttctgtctgggtatgttaaacattatacttgaagacacaggatgttgaaaatctattatgtgaaatccttgaatttgggtatctatgttgtcaaagcaacttggagcctaacagttgtccagtaactagaggcccaaaaaagaaaagaggaatttttagaagcttctccaaaagcaacaggataaaagtgttattggccttaaccgcatgatgagggctttttaccaaaggggaaaacgtagtccagttgatcatcgcagcctaattgattaattgtgggtctgaccatctggctgatgaatgctgacacccagcagtgattactgtgtaacacaattccggatgtgctctccctgatgcctcccacaataatggcaactctgaacttaaggttagtttattcaggcctcttggctcaatctcttcatggaatagtggttgtggcagggaatattttactagacctggtcaagcattatcttctcttatttcagttacccactcttttccaactctactcctacccactcctaagccctctcttgtatataatcacttttcatgcaaagcattccatctgtagttttcatcatattatctgattctctcatttctggttgctctgttctgaaaaatatttgactaaactaggagatctatactgctagaatgccatttcacaggggatcctattgggacatgtttattgtatcttatttgctactggtttacttcaaattactctgcgcttccaaataaagaaaattattttacctaattcattagcctgattaaaagtcccacatatggcccaagttttccatgagattatcagaatacaagggttaatagacgataattcttacatcttaagcctacttctgaccctcagttaggagtatcccatgaagaagattcccctggagcatactttactgttagagaaggaaagtcagacccatgtaaatgacaaggttcaatagcaatgccatccacaaaccaatctacacctggagatgacttgtacatggagaattcaccaagcaaataaaacctgtacatataaatataaaccctggggaattataacaaaataattccattgtattttgtaggaatgcacaggggagtaactgacacaaaatatcttatacaaccttgaccaacaagtcacaatgacaaatcatccgtttcctcttttcttttcccagattgatttccagctctaaattcatcttttctttcactccccacagatgctgaattcttctatgttccaggctgagttagtgttaattttcagtagaggacggcagtagcatgctgaactgtagagttccgggctgggagttgggaaatgtttttggcctgactgtcagtaaacaactatgtgtcttgggcaagtcaagtcccttaactccccatgtctcagtctcttcattgaaaaatgatagggtaggactgcataaactccatagtctctgccaacactaagattctatggttctatagctcatttccttttttttctccctttggcatcaactgctcaacaactccgctcatagtaatctctatgctctcagttactaatggaaaaatatgtccttcatttactagttggtattttgtatttgtaatctctctctttttttatttgatgctagatattttgagtcataaacaccaacatatccaaatagatgctttaaatttgaaggcgtttaaggaaaatagctttcccatgtagaatatttagtgtagcagggcatggaggaagccagccatccaaaagtggagcaaaggggccaattcacaaatgagagaaagcctttcataataagagtctccacactctttaacttagataaagctaaaatgctaccaacttctaactacttttccaatcaatcccagacaccatcacagacacttaggactacaaatctgaggaccagcactggcagcaatgcagttcttatttcacctccaccacccattgccaagcaggatttaggatggcatactaataagagccaagaggacgatctgtcatttattttcctccaaactttttgaaatttcccatttgggctctgtttcccagttttaatttggtaactgccatttttcagcatttcttttaacaggttactaataatttctgatacaggatctcatatttcattttatgctgctagagctgctgttaatatttcatctgccttcaattcagctctgaataaaggctgctaggttttgatagactgttaacactttggttctggggatttgatcactatgttcatccagtttgtccatattttgttaaaaaaaaagtaataggttagctatctcagaaatatctcagggtgtgctatacattctagggatacttcagagtttctttttctggatctttgatgaaaaccaacaaaaacaagtatcctgggtttgttttcacaaatgacttgccatttgcttcagtgtcagtattctggaagcagtgggcagtggttaagattcagggctcataggcagatctagattcaaattttggctctgaaatttattatatatatcacctcaggccagttccttaaccttgccaagtctttcttttcccatttgtaaaatagggatgataataatatccacttctattaattaatatgaggatccaataaattaatataaagtgctgaggattttctcagttctcaataaatgatggctatcattatcctagcattaataatctacaaattcacattatagaattattattttgcaacatcttttcagggtcaacaaattattttttagtacagcctttgttgtttgcttcactatagcttacatttttaaaaagtctcagtaaaatcatgtaaaatatttaaaaatttgatatttaaactgtatgtacagttagactaatatatagcaccatattattattattgtagcacttttcagtgcagcagcaaattctcaaaagtttttgtccatctaatagccagccctagataaggcacattgtaccaatactaatctgttctataaaaagatgacttatcatatttatcttctcctactcccaaagaatatagattattttaatattctttgggtatgtgtcagtcaggccctgtttggatacagagaccatatagcaatttgaatagaaagttagtttaaattattaataataacgggattaaagtaataagagtagctagtaagaagtaaagaatactttaaagaatataagaataacatgggccaggcgcaggggctcatgcctgtaatcccagcacttagggccgaggtgggtcttcagcctaggagctgaagactagtttgggcaaaatggtgaaatgccgtttctacaaaatattagtcgagcatgatggtgtgtgcctgcagtcccagctacttgtggggctgaggtgagaggatcgcttgattccaggaggttgaggctgcagtgagctgtgttcatgccactgcattcaaccctgggtgacaaagcgagaccttgtcttaaaaaataaaaaagaatagaagaataacaaatgtaaggaacagccattatttgcagggctaagatagcatatccaaggaagagtctcctccatccctggactgagatctagacattgtaggactcaagacaaaaatctcctggacccctggaccaggatccagaccttgttggacaacacacagccataactcattggatggcagagaagttgctggggagctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggagaagctacctgtgcttcagctgctgggtaccaggttagctgcatttgctgcaggagctacatgctgtaaaggttgcttatgttgtagaagccaggctctggagaaaccgtgcacattgcaggaggctgccaaagtagtgcatgacaaccaggaaggaaaatttcttctttctgcaacgtctccctaccttctctactgacaaagcaccctcaaaccagctagcaaagaaaaaatatttaaagaatccagatacatttttgcagagcaggcaaggagaactacatttggaaggaggcaatgggaggtaatacattggtaactggcacagatattattatttgctcacacacttcatgaaataactcacattagagattataatccagtattttcaactgattgcactactgttcacatttactaataaaccaactccctttgcatagttaagcaaatactgtcagaattaagaaaaataagaggccagtagataaatacctataatagaatattttaaagtgacagtactagtatatgtacataaccttttcccccaagtgctgcccacatacattttaattacatgtttataatttacttaagaaaaaaatatacagaagtactaagctattgacctaaatgtatgcatcagtgatctcacaccagaatctcaactaagtgggtattcagaagagtcattacaaacaaccaaaagctttgagagaggtaaaaattgcctcgattatcatttttcctttctctttccttttctttttaattaactctagaactcatatttgcttcttctatgacatttttgtggaggggtggggtggctcttaaataggttattcttttttttttttttttttttttttttttgagatggcgtcttgctctgttgcccaggctggagtgcagtggtgcaatcttggctcactgcaacctctgccttccgggttcaagcaattctcctgcctcagcctcttgagtagctgggattacagacatgtgccaccacacccagctaatttttgtatttttagtagagacagggtttcaccatattggtcaggctggtcttgaactcctgacctcgtgatccgcctgcctcggcctcccaaagtgctgggattacaggcatgagccacgtgcccagcaaaatataggttactgtttttcagaaaaatacatatttagaaattttttcttatgattctggtcctatattgttctactcttaatattaaatagagaagcatcaataaatgaccaatttggtaaactatgatactgtgatcattgttagaactagttttacatatggggagagagtatattccaaaatacctcccctacttttgcctaattcccttaagaagggaacaggtgcttttgctgtataattacaggtagagtttaaaaccacaaacacctgacattagcaaggagcgtggttgtgagaggctgagagcagaaaagctaattgggtgaggagagtcctgtagagagtagactatactgaggtcaggaccacagaacatctttctcaccattcatccgtttttacctatgtctggccatcagcactatctgttctcactattatggaaggggtctacttgttacctcacagttgtgttttcttaaagccagtggtatccagcaaagcaagccatgttgggttgtctcacaatcacactgtaggcatctctgccagctgcaggtggttatccttatgatttccttttgtttgtgctatgcgtgagtactgaggataaatttaatgaccctatgtttagttctctcctccaacacacatgcacacccccctctcccctgcaattcctgagttcaaaaagagatgaagacaaaggaatgtcataagtccgtgtgattcaggcaggcaagtccattttattttagtttgcccttctgttctgctggcttttctgctatgacccactatacttaacctgtcggctgttcttagtagcaacatgcctttttaatcagccttcctggggtctgcatttgattacagcatttgtgttctattttgattcttttgtactgtgccctgtggtgttcgcttgaaaggtgttatttataaaatgaaattctattgtattgccacttggattcaaagaggacatataatattaatgcagaatgtatttaataatatcttcaatctattaaatcaatttcttcatgagaatacagaatggaagggaggcacatgggctgataatcaggtaataagacttaagaatcacctgaacttttccttcacaagctttcctgaaagctggcacaagaatcattctcttaatgtcagggtttccaagtggaggagactacctttcttcagccagaccagtgcagtgcgcacctgtttaaacattcaactgtgcaggccaaacattttcctaggcttttagatgcaaattttttgactaaggaaactatgagaccaaacatgaatatgacttttttactacatagaaagaattaggttatgaaggaaatgtaatcacctatttctaaggatctactttcaagatttgtaaaaagaagtatatttgttctcacactgactcttctcaaaagcaggataggaaaattctagtgataccaagaactgatgcaaagtttccaaggtggcatgttcagaatgatgttctcacctagcaaaagggcaggtttcattgtgggctgctgggcctacagtcaaatgtttctagattagattgatggaggagtccccaagttttttcaacttctaattttaattccagctaaagactgaaacattgtacactgtatcacagcttgcacagcacatttcttgctgcatacattctattctttcactacaatttttttttcctgttgatctatctgaaatcatcaatggctatgctgctgtttggatagggaataagaaagaatttggtttgaaagatgatttaggaatcaggctctgcagaacttactaaaagaaactgtaacatacaaaggaacctggctgggcagtcttgaaatgagagttcctggatttttacctgttctcattcagtggcatattatataactccagaaaaatcagggtccagttttctaatcactaaaaggggaataactgtccttttctacttgcactgggctactttagggatggataagaaaatgattccagaatcttgtaaatgctttgcaatgaagaggaaatacaaatgcacaatattattaaaatgatagtttaggccacatttttgtttctccaaatctagagatgaaaaatagtaacaaaggaataaatttcttccacttcaaaaataaataatatacccttatttataaatgacatgtcaaacataaggaactaggatgtgttggggaatacacatctcagttttgaaggcatcaaattataagctatttgcatgaaggaatcacattcatctctgtatccacccaagttctacctcattgatttacattatgtaagtattccattcgttaacatatgttgaattgaaatgacaaatgagatcgcacaattttagagctcgaattaactagagaccatgttaaatcctgttgcctcattttgcagatgatacaactgaggcccagataagtaacttaactaagtccaatactaaaaatattacaagttttagaagagttattttaaagatctgccactgaaaatatatcactgaattaaaacaaaatagacattcttctgtcaaaataagaagcactattcagctcaaataatccgatgtatcctaacctaatcaagaaggctgaagcctaaagtaacaagtaaacataattaaatagctatagacccataggcatgttagaaatgccaagttactgaggggtgcatatcttaatactttgtctatcagccagtccaaatggcatatttttttcaagtaaaattaatgtcttaacaaataataggggtgaagtcagcaagatggcagagtggaaaactctacctctcattcttccacagaaatactgataaaacaatgttggaaccaaaataccttgcaaatatattcagattgtagctaagaaatagaggcaccctagaggatcccaaactaaaagcagttgcatttgcatgggtaaaaagtgcaatttcatgttagaatgtcatatcagtacttcccccagactggcttagctcaacactgagaggactgcttcagctcatgatttctcctgtgccacagaaagtgagattggagtgtgtatctggcttcctggcctctggcctctcagagaaccctctgttgggtcagttcctatattgcctcatactgtgtactgacgcacctgtagaacttcgttcccagggatgcgtaggagcaaagaaatgaggagggcaactccttacagttagagctgccttgcaagattaggaatggggcagaactgaggttattcttagatgagggaggaaagggaatgaagggggccttattctcagcatttcagagttccctctgtgaagccagtttccatttcaccttgtactgagccttgtgcgaccattagaacttggttctgagggatagttagcaaaaactaaaaggagcaggcatccctttgcagctggcactgctctgtataataagaaaaaaacatagaaccgagccttttccttgagaaggcaaggaaagaagtgtaaagggccttgcccccagtcttagattgtgctccccaaggtgtatgtctctatcttgtctcatattaagcaccatgaactggtaaaggtctctactcatcaaaactcatctgtagagactgggaaaggtagctgctacttcaaatatacagatcacaaagaaaatctacaaggaacacaaagagtcatctccaataaccatcctgaaagaaacagagatccctgaattaactgacaaagaatgcaaaataaatgtcttaaagaagcccagtgagttacaagagaacactgagagatagctaaataaaattaggaaaaagatacaagaacaaaatgagaagttaaataaagagatagagactattaaaaagaacccaatagaattactgaagctggagaatacaaaaattgaactgaaagattcactagaggagttcaaaagcagacctaatcaagcagaagaaagaaacagtgaacataaagacagatcatttgaaattatgtagtcaggagcacaaagaaaaaacaaggatgaaaagtgaggaaagcctaagtgacttatgggactcaaacaagtgaatcaataaacacattagggaattctggggagaagagagggaaaggggtagaaagcctatttaaagaaataatggtaaggaacttcccaaatcaggggagagaaatcaacatccagattcatgaagtccaaagagctccaaagatctacaccaagacccattataatccaattgtcaaaagtcaaagacagaattttgagagaaacaagagcgaagcaactcatcacattcaaaggagtccccataagactgtcagcaaatttctcagcagaatcctcacaggcaaagagagagtaagatgacatattcaaagtactgaagatcaaaaaacaacaacaacctgtcaaccaagaacgctatactcagaaaagccatccttcaataataaagaagaggtaaagactttcctagacaaacatgcagaggggtgttcaccatcactgtacctgctttgcatgaaatgctacagaaagttctttaagctgaaatgaaaggatgttgattagcagcatgaaaagatgaaagtataaaacttgccaataaagtcaagtatatagtcaaatactagagacctctagtactctaatgatagtgtgtaaatcactttcaactctggtataaacattaaaagacaaaactataaaagtaatgacatgatttgttaatggatacacagtataaaaagacgtaaattgtgacaccaataacatgaagtgtgtatataggagaagtaaaagagtagagattttgtatgtgatcaaatttaagttgctatcagcttaaaatagatgattataagttgttttatggaagcctcatggtaaatacaagaaaaacacctgtagtagatatataaaacataaagagaaaggaatcaaagcatattgctacaaaagataatcaaatcacaaaaaaagacagcaacagagggacaaaggaactacaaaacaaccagacaataatttaaaaatggcagtaataagttctcacctattaataattaagtgtaaatggattagcttccccaatcaaaagatacaaactggctgaagagattaagaggaagactatccatatgctgttaaaacagcaacaacaacaacaacaaaaaacaacaacaacacactttagctttagggacaaacatagactcaaagtaaaaggtgggaaaaatatattccaagcaaacgataaccaaaagctagtaagagtggctattcttatatcatacaaaatagactttcagccaaaaattgtcacaagagacagagagaaggtcattatataacaagaaagtgattaattcattaaaatgatataataatccccttgattaggatccttttgattggaatcctcttgactggagtagaacaaaaactgaataattgtaaactattattatgaagtagagatctccaatacactactttttatttttccaaagctttcctggagatcacagagaactgaacatggagaaaaagtgagcaagagacagcagtaggctttatgccttaaatggctgtatagcttgttaaagattattgtttgtgtattaaaaaaacatgattctagaaacataattggggtttcacagatcaaattcaaattattaacttagtatttcagcctccattacttgctctatcttgcttaggcatcctaggttccagtacttcccaacaagtgttctgtggtgtatgcagactatgttagtgtttccctttattttggtatttccacaggagacctaattttaaattttctgttctatcatctccatgatttcttaaattatgtctagacttctggattagaatattattcatgtacttactatgattcaataaacatcttctatgtgtgagacagtaggaataagatacaaataagacttatttcctatcttcaaagaataaaggaattcacaatacagtggccacttaaatatataacatgtgttcctgcttttaagcttttattctttctataattagagtatcctatcattattttattgattgaattcctttaattatcttatagtccagcttatgttctgcttcttccataaattaatttttactttttatagcccacactgtttccttttccccccactattacagtggaagtggacactattccctaaccaaacttcattccctcattcttcctagccgcagacctctattttgtgcagagtgtcaatgtgctcagtgctggatgatgagttttgaaatttataagccaattatgacaagtgtattctctaatttgcttgcttctctagcaaagaagggtggcctagggattcagttatagccaataagatctatgtggcaatccacttgagaggcaagtttctgagaaagctttttttttccgttacaaagaggaaggtaaaaggcaatccttctgtttcctcctccttccctctttgaacatagacatgatgcttggagttgtggcagctattttgtgatcataaagtgacaagcatgaaagaaagacaaaaagaatcccagagatatcagcacagactttatcatataccaggaatttcctacctctcaacttctggacttcctgttaggtgagaaaactgaatctctatttgtttaagccacttaagtcaggatttgctacctgctgctgaacacatttctaaccaaagtaataatagtaacattcataatttgaattcaccaaactgttcttcctaactagataacagacattggtcacattcttggcacttcataaacattcatttgcttcacatcttgattaaatatgctagacttttatatgtaatgaaattctcacacagaaaggaaggggggaatttggattagtatcagaaaagaggatgaaaccaggtcaaaaaaggaaaatttgattctataataaaaaattatatgacaaaaatttgttacaatgtagctcaattattatatacaataaaagcaaatttttaaatattttccaaaattaatagcaacatattttaagaaataagacagtagaataagcccccaaatgataaatgttttaaaggagagatgatataaacaagtcttctattaaatgtgaagacaataccatgcagttctactgaaacctaagtgaggaaccagcgtttgtcaaataccaccagcaataagactttttctctgtcctttaggttgtatgactgtgattcaccccaatgctacaggctccttagcatgctcattatttctaaaatctttcacctgaggtttgaacccatgacttaggaaactattatcgcatttgcttttggagaaaagactacataagttgggacagaagctattttcaaggcttccaaatattacaagtaagtagtggggaactgttgagaagagaaatgagtagctttgggtcattttaggttagtgaccttaaacataaggtgtgatttaatcagaagccagagtaattatggcaggaggtggggaaaaagactcagagctgtctggagttagggaggactttggtggcagctttcagcttgagctaaaactgcaggattctgtcagaggctccacaaacaaagggctgcattatgtaaggaatcttgtatttctttgtgaactagtccacaacaaaatttcattagtttttttttttttctctcctagagatttttttttaccacttccagcccgtaacttgttgctcagaagggaaactttctaccttaaataaaagtttaaattgtaagcaaactgacatttttttaggaacaaatcaaattaatttgaactttataataactgggaaaatgctttttaagttaggtggatgataagtaatcttatatgaagaatttccaaataatttagcaatagttggcaataatttagcaatagttagcaatacgagttcatatctctctccctctctgtctctatcattttctgatagtctgtttacacatgtaacacttttgggtcacctttcaatggagcatttcataggcagaattggaagatagcaagacacatggatggcacatagcaataggttctcataaatattatctgttttcaaaagaatatttatttttttgcccattataaagatattctaagattaattacagtcctaatactgtcaaatttagctttgatatacaaaaatctattttttagtagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtggaatgaaggcaagttataggtaacatacaaggattttcattctgctggactttttcattcaaaacagcatcattctcagactcagaattatggataaccatgcctctcagtctactcaggagagtttccagtttcagttccaatggcccagtcacaattattagtagtgttcattttcactttcaaaagtgtcctagtttggatgataaaatatggggttaccctgtatataagctttaaaaaagttagtcataacaccatttacagtgataatcattctatttaggacaaattaaagtagactctattggccaacttctataaagagaaagagataaactaaaacattattaatttaatctcagagctttaatcagaaaaagtttattttaagatgacaacaaaatttctatgaattatttaggatttctaattttaggtcatttttttttagccttattttatacaagcaagcacgtatgcccttaagatttgtggtggagaaagaagtacaatatctgaaataaagttctttgaagcttaggtttgaattctaattctactatttactcggtgtgcaaatttaaataatttctgtgaacattattattaaccctttctaaaatatgtttaaaaacattttaaaaaccagaagggaaagaactacatatgctgtgaaaagctgtaagttattaacagttactattatttctctttataaataatgatagtttttccctttcaacttctatgacacttttacagactgtagaaaaatttggccaagcatgttgtagcaagggtccttaactgtaatcacctttgacacagatccatgatatttctgggtgacatctctacatggacattgatggcctgcaaagatctagaaaagaaagactatagatcttgtacaccaaggccaaagactaaaaggctgaaatttaaagtacaaaagtattgtgaacagttttgttagtagtataatatataccacttatatagataatttttcttatatagatataagaataatttttcttatatagatataaaatagggtttcttatatagataatttttccatggaaggaaggggaaacgaggcgaaaagtggctggagtagaaagactagtttgtaaggcagaaagattttctaattactaggtagattttattttattttacttgtttttactagctaaattttaaaaaagagattcctagatctctatagacatgttcctctttctttttgctgatattttcctatttcttttctgaaatcttaatttgactagaaaaaaaatgatgttctgatttaattctcttagtctacctgacatcaaaaagtatatggagggtgtctttagttttttatttatatgaatgtaatcaaataattttattttttaaaaaaagactctcactgtttttcattgtttaacagacatttctttaaaactttgaagtaattatagaaaatgttctcataaattttccctccaaattaaccaggtagaaagggctaatcctgttatgcatgccatttttgtttgtttaaattgactattctgagaattaagtctgtagtacctagtttgaggcctcaagattttcaggtatgcacaaggttctatcaactaattctttgtctcactgatgatcctttattttaaatatactctacttgcaaaggtggtagggtaaaaagaggagtggctgacaagagactaaagaggggaaaggattcccaacatccttaatatctcagggctgaaaaagagcattagaaatcttctccaatctcttggagaaaaaatatctttcacacactctgtctattagaacttcatttgtgtttaacaagcccctcttttaaaatgcaaatttgccttgtgaacctgtaaacctcattcacaccttattgttaattactttgatgttctagaatatgatcaacacttaactgatattggcaatctaggaatgaacaaattgctcagggtgaaaaaaggaaaattttgttggagtggggctgtaggtggtagtgtgagaatttcatttgtgagaaatagagcatactgatattctgaagttttgtctaggagaatggcagtagttacggtaccacaaaacgagcacttttcccgactgccgatgtctagttgagatcagaaaaagcctggaagcctgcaaacctaagttttaaatatttagccatagcaagctaatcaagcttgcaattttctgaaaacgttttaagttaattcataatagctctacaactcggtgaccttgggttctaagactcatttggttcaaccttccaggtttaaaattcaaccaataaatgaattccaaggaaaaaaagtgaatatggcccagtccttttttactgtctccctagtcattcacttcagagattttggaatgcaatcctagaacatactgtaagcaatttcagaagaatacacaggatgcagtatttctctatgtgtcttagtaaatgtcacttgacccgatatatcaaaaaggttgcaaaatttgaattagactttagttgacttaagctacacatcttagcttggcagaaattcaaggaaaaaaatattttatggcctcttgtaacattattaatcacccctccttttatataaaaaataaatatgctaaactcttcactgttcagaaaaggggtcatttttcctgccaaaatggctaattttagtttttatgtagttggatacatttgtaaactattacatgaaaacatatggttggaacatgcttactccttcatgagtgttccccttttgaggctgcaaaattttccttagttgctccatgtgctactttgttgtgctgatgacttcttgttctaaataattttcttcattttccattgttaatgaaatgagttctaataaggaacaaagaaaccctctgatgaaaatccctttcttgtagaatggactgggaactgatataggacacaggggaacagcaaatgctgtgttgcacattcttcaattaaatgatccctttgtagtttattcacctgaatgcattttggcaaagagtgaagcaatagtgggaaaaggattgtttgtgtggctaatctttggttactcagaaagtactagacatgttttcctgcatgtttgattgatttcctgcacagtttgattggtgaatcaacactttaaggtatctaacccataaggaagagtgaaaaacttccccagaggtattgaaatttcactaaacctcttcttggagttttggtgtatgattctcagttgatctttgagtgtaacagtcaactattaaattggcatgactgaagtacagttttttcaaatagaagagtattttagaacaaatgagaattctaactctttaactgaatttctaactttacattttgcccgtacctctccttgtaacattcttccctttttccctatatatttttaccagtaatcctttcaactgctccttaacagtgagattctactgttctggcacattataggttctctttaactattttttgagtgcacaaatgaccatttggacaaatattataaaatgaacaataaaaaaccttaattatgcaaattaataagtctatacctttgggaaaaaagccatgatagtaacaaaatgaataacaattccaaggatatttaggaaggataaagcctagaagattaaaaatgagaaattttagaatcataaaaaacaaaacgaaataaaatagctcaataccattgaaagcacatgtatgcagaaagaagctaatatattattgtaaaaaattaaatggaaagaaattagaaatctattggtattattacatcaaaagcaggaagttctttctttctggtccaactttagagagaagaacaaatttgccagtgccaccaagggcagaatagagagagatgtttggaatttaagagttacaggttatgttatggttcatttatatcattgccatcactgcagttcattcattttgtgtctaattattgatgttgccacggttgtcaataaacgctcagcattactaatcatcagagaaacgcaagtcaaaaccacaatgaaataccatcttataccagtcagaatggctgttgttaaaaaatcaaagaacaacaggtgctgcatgattgtggaggagagggaatgcttacacattgttggtgggaatgtaaactagtcctacctattaggtactgtgctcattaccataggaattagggtgggattcctattccaaacctcagcatcacacaatattcctatggactaaatctgcatatgcaccctctgtatctaaaataaaagttgaaattttaataaagatggaactaatccctcatatcacagaattatgtagttgtgggtagtcaggataaagaatatttaggatataatttaaatgaattcactagctctgaaaatgaaagaataaacagaaaactaatctagacattaaatttttttctttccctaaggataatgtatagtccctaaggataatgaatattcaaggacatactgtaataaatcatatacatttattattaatataatatagtttattgcacacacacactatgagctccacgatgttcgttgaactattacaaagtttaaagacatacgaaattacagtaagagccatccatataaaaataaaatgttagtgtttggaaggaccaattgtaggagactatattggcgagttaatacaaaagatcatcttttgtttaagagttcatatatttttgtgtaaattatatctatttacagaaattttctttactaccaactgttctcaaacccattcactaataaataattactatatgtgattacttaatatttacctcaaacctttatgaatatcactgaaagcattactggcaaattaattatataggcaaatggtgaggatctctcaacctcacctctcaccttcttcccaatcactcgaagactgactatatcaatttgtcttgttatccagaaattggctttatttgttaattccagagatgcttcaactgtagtttcagccagctgtttccttacatctttctgggtggcatcagtttacaatgcatagcattgttgagggtcaaagttattttattttggtattactattggatttttcccccagtgcctcaaaggggaatgttgagtcatggagatgtaatgtgactccttaaactaagtagacttctaatacaagtatacttttattatggagaaaccaaattaattttatcaattaaatgagaatttatttaccatttgcctttaccagatatttcattagacacaattctcagactttacacaattacaaagaatgttgtataaaaactatctataaagcaggagatatttcattcttagttttttgccaaacaaattatgttgcttcgaggaacagagggaaaagaaacattgatgaaacacagccctcaactatggcataaagtccaaagcacagagaaggtcagaaaagaataaagcagttttgcagaattattatgatagggagtactgataaagaagagtcaactttttggccttagtcatttactgagttcctttattaaaaatagagcataaacattttagaaataattttttctcaatctttttttataaaacctctacagaaaaaagaagcgttatgtgaaaagcagctaaatgggaggaaagtaggggtctgtgggtgaaacaggaggttaccattgcaaaccctgtccttgatgccctcactcagtaggactggtggatggaagaagtttgaaaaacttttatgtagagatgaagaaaagtagaagccctagtttacagagaacgaaagatacatttttcttctgtgtaggtagagtttgtatttggagaaggaggagactcctttcttctgatgaaaactccttcttccaagagaaaactccattaggaaaaatggagcagcagtgagtgagagagaccaggtttaagatttgttttggaggttaaatttgttgtggaagttgacagaatgtggtgaaagcaagacacatcataaaataagccaaaaaaaatctctctcttccagctcattgtatattggagagttagttgacttttctactgtaaatgtaaagaaaacaaaagtttcattcatcctcctgtaatgatgccaatctaatttgctattaaatttctattcaaaagccctattttgtttagttacaagggatttgatccccttaaactttcccaggcaatttgtatggaaaggcggttgctaagggtattcctaagggaactggcaaacgttggaagataaataacctcagtacaatatgcagattaagtagaagggatggtttaagagttaccttttgaaggaaaaataaaagattcagaattcagggctagagttgctagttaatcactgatttgaaggtacttaatcaaggcagttttattttattttattttatttatttatttttttttagacagagtcttgctctgttgcccaggctggagtgcagtggcgcgatcttggctaactgcaagctctgcctcccgggttcatgccattctcctgcctcagcctcccgagtagctgggaccacaggcacctgccaccacgcccagctaattttttgtatttttagtagagactggctttcatcgtgttaaccaggatggtctcgatctcctgaccttgtaatccacccgccttggcctcccaaaatgctgggattacaggcgtgagccaccaagcccggccaaggcagttttatacttctcaagaaagtagaactttcacattgttcctcttgggaataaaggtaaaattatcatagagaggaaattagagagaaatgttcaccatttccttccttatattcttcctttctttcctctctctatctctagagctcttcctcaaagattcaaataaccaaaaatatgaagccatgggtggcagcttggagttctcaaaagtccaaagtgaggttagcttctgaccaaaacttttggcaatttccttaggttgagtgaaagaagcaatgtgaaaaagcatgagtttagagtcagtcagccatcaatttaaaatcaaactccactatttattattggtgtgatcttgaatacattagccaacctctttatagtccagtcatttctaaagaggtgattatctatgaaacctgtattacatatacaatgtgtaagtactcagtaaatactcagtacttctctagtatctctctaattggatttggctagtaatcatgacaattgtgggagagaaaaaaaaagatatgtaatcctgagggcactcagtctctgtaacaatcacttgataaataatcaggtgatacttcgttgacatctctttaatcttccaattgagaaaacattaggagtagaagaaaaatgattaatctccaacttctgtcattggaaaataactaaagatcagaactataagaaacataaaacttttctagattattaaagttaaccttttagacattttccacaatcacatggtatgcaaattttaactaaattattttacattaaatgtattttgtgctatgttttgactagttgattttactgtagtatagaatgtattatgacattccattatcctcttattactcatcaataaaaaatttattgagaaaacaattaattataattaatatttattattcattactagtaggcattgtagtaattacactattattggtattttaaatatcattaatagctataaacatgttatacataataataatagaaaccatttgtggagtgcttactgtgtaatacattttgctaagcattttatatacattcttaaaattaataatttcaaagatttaatgagctaagtgtcaccagataaacgagaagacataataatctttatttattaaaggaaaacttgccatatccacacaatcttccaaagcactgatagaacagaatgatggcatgatggcatcttaaatttagaaagtgtcattcataaaagtgtactgttaactactaatttgtgctatctgcaataataatattatattacacaagatggaaaggctaccccctaaaagatagcatttgataaattgtacataaaaatctagaagaataagagtataacagaggagtgaaatttgatctgaaatacagagaaaattaagaaaaacaaaacatgttagccctactggaatttgtctcaatgtatttcaaggttcaaagtatagcagaggaagatcattgacactgtcagaggattatcattaaatttcaacccaaaggcaactaactcaaactatgcagatatggaaagtagtgtttcctaaaatgaaactaaggcaaatattatttattctagcttctactcttttgactaatcagctgacccagaaattaaatatttaaaggcttaaaaataatatagttttaagaagttgacctatacgttactaaataaaatgatcctcgttgtatttgaagtagctcaccatttaaaaatttaatctatgtccacccattttctttcttcccaaataatacaatgatttaattaccccacagtttaatttgacagaggagccaaaaagatacactattccttcattgttaactttaaggagaaaaatacactataaactatattagaaatcttattttttgggtgtccaccacaatgttttcactacaaaatcccttgctgcctgaatacaaaatgttaccattcaatcagatgagtctccatgaagttagaaacattcaagtgaaactcataaaataaagaagatatactctaaaaattccagttcttgagaagctgtttacacacaaaagggctattaaaagtgaaagggtaagtagaaaatcttctgggctcatttaataaaagaatgtagagttccatgggattcttttctaaagaaaccactaacaatgttgcagatctacaaatcctaaaagagtgcataatggactcaagtctctgctttgtgactcatgggtgtacttcatcaggatgtacttcctcttttagggggtcatataggtgaataagctgacaacaccttcagagagagaaattccacatgtgtcataggaatagaatttatttgatctcaagctttctatatatagaaaaaaaacaaattctaatccaaactttaatgaattcagtattgttgttgttggtttgcctctagaatgtctcttttgaccaagtcacattcctttaaatttacactaggtaaattatatattttccaaatcttttataaaagcataagctaaatgagataacattaaaaggctgattggagatttccctttaaaagcagtcataagaacaacagcaataataatataacaacaatatacactacattttgggcaccatgctttgaatttatatacactaatattattaaggcaatctgtgcttttgagaagctactccagactaggcactacacaaactctgccacacacaagagagaaacaatttcaattacaaagagagctagaaaataaaatggataagagtatcatgaaagattttttgtaaaactgaatagatcctttcatgtttctcagttttaatctctccaaatatccctattgtctgctttttaaaagaaaaaacactgtaaaaattctgaaaaaattattcacaaagaaaacttccactcgtttatataaagcattattattaacttcataacatgcataatatcatctatttctgaaagaccattgaaaagtagccataaaaacttaaaaaattgaaaataatctttagagatcaacaggccaggaagagttctaagaatatgcattggcctttactaaccattttcaatgccatgcacttttgtctgtcaatactttctcctgttatttttaatatccctagattaagaaatattaacatctatttacaaaaaaatattctaacagtttcccccacaaaagcatattcccatgaagatcaagaaaacaaaaaacatagcagggagtcagtattctgacagccttttagtcttcttcatcttcttcctactattattattagacctactgcctattaccagtaggctttttaaaggtcttggacataaatatcagttgttaagttgctattttcatggtcatttaaaattatttcaaccataaatgcttttaatttcctgaatatcttaaagctgtctaagtataaatattctcccattatattcctctgtgctaacacaataatctagttggagtcaagtttcatgaaaataagaaaattggtacattataacattttaaacactgaaaaataaacgtgatagctgtaggatgtaaagtgtagtcaggcctgtagaacttcggatgcatcattttacaatatcatttatcattttgataaaactgaggtcaagtttctaaaaatacaacttgttaaaagcaggaataaatgaatgagagatgagtcagctcgtttgatggaaagggtttaaaaaatacttcaaaagcataccacatgacttggtaaatattcagtgtatcaaaatgtagttgccatctggcattgatagactgggctagaatatgtgtttaaaaagaacaagaaaggaaataactcagccaggttaatgtgcacttgtctacatttcataattcaggtattaagtgctttaataaatattcactatgaaagaaaggctgcattacaatcagacttgggcagtatttgttggggacagctagaaagaaatgaaagaagacaagacctgatggcacttaagaaagctaaaaacaacaataaaaaagtggtttaggtaaacagaattctcaatcatatgtaatattgccagaacactagtatcacagttaaatgcagggaagtggtaagcttatatttgaaaataaactgaaatcttgcttattttcagctttgaatattttaattattcttttctttggctttgacaatttaaaagtatagagaaatccagggaataagtaaaacccttggttggatagtaaaaaaaaaaaaaaaaaaaaaaggaaaaacgaaaaagtcctgacattctttgaagttttaaacctagagtttgatattaactttgcaatatgcaacaaaacaaaaagtaaatttgaaggactcctcttttctccctcttgctcaagaaataaaatatatttagaaagcagtatcattcacaaaagagaaaagtgaacacgagcagtgaacacttgcccaagcgttcgactgtccaaggctgtatctgggcttgttaattagatatttctgtctttaaccttgaacattctccagatttccaaatcttgacaatttacattctaccacatctcttggaatcagagcaataggcagaagagaaaagttttaaaacagctttgaaggttaattaggacagggaccagggtagccattaggaaaatagatgaagcacttcaggtgagagttgattagggtcaacatgaaatttttcagagttgaggtataatttatattcagcaaaattcatggacttcaaaatgtacacagaatgagttttgattttgataaatttatacacctatgtataaatatgtatatataaaaatgtatatatttaccaccataacagagacatagaaagttcctttgtgcccccttccagttaatttctatctcccataaacaaccagcattctgatttttatcacgatagaatagtttcgccttcacataacttatgtatactcttgtgtcctggctcttctgcataccatgtttctggaattcatctacattgttgtatcatactctgttttgttttatttgcttgttagtatttcattatatgaatataccacaatttgtatatccactttccacatttgggtgcttccagttttaggcaattacaaataaagtcagtataaacttgcctgtacaaatctttttgagggcattattttcattattttttggtaaataactaggaatgtaattaccaaacaatatggtaggcatatgcttaaccttagaagatactgatccaatgttccaaagtagaactatatatttacagaaagtcttgaaattaggtaatgtgagtctttcaactttattctttttctaagttttctgcaatctcatatacattttaaaataaatttgacaatttatcttaatgttagaaaaacaagatgttgatattttgatggtgattgcattgaatctacagataatttggggaaaaatgacactttagaaatactgagtattcatctataaataacggatttttctctaaggccttttaaaattttgagtggggaatcttacattcttttgttaaacttttatttaaatgtcttatatttataggctactgtaaattgattttaaaacttcattttcaaattatttgccggtactacataaatgcaatcaatttttgtatattgatcttgtgaccttcctaaatgcactgttagctctattagttgttttgtatatcccctaagagtttctaatgtaaacaatcatggtatttgtgaataaacacaatgttacttcttcctttcctatgcttatacctttaatttattttactcgtcttattgctctggctaggatctttagaacaacgctgaacagaagtagtaagaatatatatctttgccttctactatatcccaggaggaaagcattcagattttatcattaaggacggtattaattatatgttttcatagaggcccttcatcagattgaggaagtttcaatctgttctaattttctgagagttttcactgtgaatgactgtcaaattttttcaattgctttttctgcatctattgagatcatatttttcttctttattaggatgcatttacagtgatttattttcaaacgttaaactaaagttgcttttctgagataaatcctacttgatcatgaggtattatactttttactttttattgttgaagtttgtttgctaatattttgttaaagattattgtgcctagaaccatgaggaatattggcctatacttttattttcctgtaatatctgtcaggttttgctgttgggattatgcctgtctcataaatcaggaagtgttttgtttttacctcctatgttttctgaaagagtccgtgtaggattaatattatttcctccttaaatgttatatagaattctccagggaaactatctaaacctgaagttctttttttaggaatgcttttgacgacaaattcaatttctttaatcaataaaggaatattttgatttctttggtttactatgccagttttgttaatatgtttttaaataaatttacctattttatcaaagttgttgaaattattgacatgaagttttcataatattcccttgttatcctttaatattgttatgatatgtaatgataatctctcattactgatattcataatttgtatcatctcttttttcttgaacttttctgttatagcttataaattctgttaatcttttcaaatattcatgttttgctttcattaatcttctttgtagtttgtttttatttcacagttttctgcctttgttatttgttttctttttttactgcttttgggtttaaaatgattatactttcccactttcttaaagtggaaacctacgctattgatcttaaacctttcttcttccttctaatttaggattaaaagctcaaaatttctgctaagcttctctctggctcatattataaatgtcaatatattgtattttcatttaatcagtttcataaatttcaatatactgcataacttaatttaattattttaaaatttcatgactttcaaccatgaggtattaagtttgttgtgtagtttccaactggtcttttctagatattttattgttttctttttttatttctaatttaattaattataaacaagaagcatattttgtagtatctcaatcttttgaaaatgtttgaaactcatttgatgaaccagattagggtctactttaataaataaagtagaacatacatacaggactctattcctgtatgttttaaatatgttttaaagaacacatattctccaggtgggaatagaacacattctccaagtgggaatagtgttctgtaaacatcaaacaggtcaaggcagttgatggtgtttttaatttcttgtgtattcttactgattttctgcctatttgttctatcaagttctagaacaagaatgttaaaatctccaattgttattgtagattttactatttctctctagttttctgtcagtttgtgtctacatgtttatgacttatgcattcatgataatttcacacatatgattaggaaatatccctccttatctctaatagtactccttggcataaagtctattctttgtaatattaatattccaacctagctttctcatgcttattgtttgcattgtatatatctttctatcttttcactctcaagatatccatgttattacatttaaagtgtattcctgtagacagcatatgttgactcttgcctttttattcagcctaatactctctcttttaattgtagtatttataccatttacagtgaatggaattattgctacaattaagtttaggtctaccatttatttcattatatgcttttgatttttttcttttgggtttttgtcattgttattcttctgttttcctttcctttttttttttttttttttttgagacggagtctcgctttgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcctttccttttttaatgagttaaactgatcaattatttttccattcaattgcacaactggctttttagctgtaccttttttgttattttttagcagttgttctaaggattacaatatgcctctttaattatcactgtttacacagagttaatattttaccactttatgcaaatgtgagtatcttataagtataatttcatttactgccacccagtactttgtagtatttttacatacttcatatctgcaagtactatagactcatgagaaaatactataatttatgcattagtcagtttttcttttaaagaaattaaaagaataaaaggatattcttttacatgtaaatagatactttaaaatttttagtgaaaattttctgtaaaaacaagtttctatcttggttcatagtgtcatttcccttcaccctgaagcactcactgcctttcacactacttataggaattccactgacaacagaaaattcatttcttcattattgcaagatcacattgctctacataaaattctggttttgcagttgtttttcttttcaatcattaagaaatggcattacatttagtatgaggaatgagtcgatgtttgattattcccctgtaggtgatctattgtttccacccttagggctgcctttgagatttttctttgtatctttggtgtacagaagtttgaatacagtgcctacatgtgattttctttgcatatttttgtgttttttctcagcaaattttggacattttcagctatgatttcctcaaatatcatttctgtcccattttctcatctgccacccacaatctgctgttaagattctccaacaaatcattttttatttcagattctgtactttaacctttggttctttttagtaatttcatttcttttttcttcttctgagacatgcaaagtatagtggactggttgatattgttgtacagatcactctgcacatttttgaatcctttttctctctgttctttacattaataatttctattgacctgtattcaagtttactgacactttcttctgccatctacaatctattgttaagccacttcaatgactcttcaaaaaaatttcaggtattataccttaactttttacttatttttgaaaattttcatttctctgcttattttctcatctgttccctcattatgactatatatatacatatatttttagagacagggtctcactctgttgcccaggctagagtgcagtggagcaatctcggctcactgcaacctccacctcctgggttcaagctatctattctcatgcctcagccttctgagtagctgggattataagcatacgccaccacatctggtggattataggcgtgagctaccgcaccgggcctgaaaacatatttttttaaaatcctgaatatatttataatttctgctttaaagtccttgtctacaacttctgaatcatcgaggaatctatttccatggactttaaaaaaaaattacatgtcacatttttctgtatccatcactggtaatttttgaattacagttgaacattgtgcatgatatttatacaaactctgggtttggttatctttctctaatgcaatgcatttttcttctagcaggttattaaattactagtcgaccactttgatttgaagaggactggttttattatttgacagaaactttcaatgcttcaggtttgtctctctttctataattaatttcttagttcttagctatcatctatatttctaaggtttgatccttctgggattcataaagcctgagacatttaccaaacccttctaactttgtaaactcaaactcctaactttgtctcctcttcatctaatgtatctgttcagctcttttagctttctagttgttgcttttctccaggcacttataggctcccacatacatgcacagtttatatcagccagaatgttagggtaacttatatgtagattcatgggagccttccctcgatggctccatcctttctaatacttccttcctcaatttcagctactttgccaatgccagctccattcgctaacatcacaaaccaataagattgtggttttctgcctgaattctaacttctctataccatacagactgggaagttccttgagggaagaagctgtaacaaacgtgaattttacccgggacagttcactccagattccaactgcttttggtcactctccggtgccttcaaataattgtggtgttttttttttaagtttttaattggagtttagttttatttttaacccataccatggtttggaactgttatctgtggaaatatttgtcctgaaacagtacaagttactcctttattaccaaaatcacaactaccaaaattgtggttttatgttagatagcacttgaactgatatggaaaactgcattagaatcaaagtgtctatagggcttcctctctcaatattcagtattttaaaattgagacaagactattttttaaccttaaaaaaatcactcatagtgccctaggaaagtgctatatattccactcagtcgctaaatatggccaatgaatatttctataattaaatttagcagaataatctgtgaataaaatgaaacagacctgtatgtaaagaaaactaccttaatgaacttgcttgggagatcagtggtatgtgatatttctaatcatgacagagaagttgaacatgtggtacagttgtgtagggaaaatggataactcttatcttcattattttttaagtcattctaagagaagcatttgctaagtagtttatatatatgaacttatataattttcataacaatttttaaaaatagtattgtaacattattttgtagatcacaaaactacaaagtatcccaggccatcagactccagagttaaattccaaccattccctctaactacctgctcagaattgagataaaactcatccacagcagtcatcattttttctaagaatatacatcacctattaatgttctttcccatctcccatgttaacaactttcttcctctatcatgtaaacttgctctctatcatctccgtgcctttcttgttcattttcatggagcagccataaaatggagaataacaattgaagcagtgaatagccaagaagcatctctcaatcaatgaacctgagacagcctgttcacttctgtccatcattcttgtcctttagatctcagtttcaaattcatttcttctagacattcatctcttcccatgtttaatctggaaccatctacccttccaccagaccaattatcctggcaaattaatgtaatagaccagtattaattatttgcttgtatgtcttaacaacattctaggtgctgtgccaaaaacaaatgaatagcaacacaaggtcttctggttacaagcacattacattttggttggggagattttgacccatctcacagtcataatcttcatccaggttatctcgtcaacctctatgtatgcatatattccaatattttgttttgcttttctttcttccttgtagtaatttcacacagactattcgcttcaagaacctaactaacttcctgttggtacccaatcctttaactctagagggtcaaatggagccctgtggctcctggcagtgttcctgaagatcaggtccctctggtggaactcagttctcactgccttatctaaccttcctcactcagcttgtaatcaacttaacttttaaagtctttgtacacattaggtaatatttgttctctgaactcccagaggggctgtggtaactgcccaactaggaagccctacccttcattattcagcaacagcttgaagaatattctaattctaactttccgccctctgacagaccagctgcatcaaaggctgtgttcccctgtttgtttttttcctgaagcagagtcaccatttcaaactaagtaatctatgagaaaagtaagagctctgggtccaaatgtttaaaacatggctcttctgtgaaccacggcaaatctaaactggattatgccttatgctggagtcagaacttacttggtcccttgttctttgccctctggctccctgcatgctgttcaggggaagttactggcttttgaactggcggtttgaaaacgaaggcatttttcttttagggagaacagtctttcagtgatttaaacaacaagccttgtgatcaaaataattcataaaggaaaagatttatgaagtgacttcactagcacacaatgcattttaaaaactttgttttttaaataaatctgtcagtacagaagccaagacaacacatctgaatgcaatatcagtggacacaccctgaatctcttcttctttgcttgtccaagactgtggtagaaaagggaaatgattctctttgtcttttcttatttaatattattattaaaaattttttaaaaattctagttccatgaaaagactttgaaaaattgtgcctacttttgtttcctgcaggaaaacctgccttgtaaaaatgtattttccattgaccacttgtgcttgtttaagaaaataaaaaataaataaagaactccaacttataatgaatacctctggcattagggagcctgttctaatctccctttatcaagtttgagtgatagttctgctcaacgagtattgacagggccgtcctgtttctcaggctttcgtttccctcggttggagaaggatacagtgcattttcacattctcaaagtctgcagttgtttttatataagaagcaatttgcttgggtcacgtcaggtcgaatgggatgcctgcccagctcttggttttaaaggaaaaacatacagaaagacacaaaaacacagcagtttccttcattaaattccactctacctgccatgggcttctagccacaatggaatttcccaccctggcctagcctagcctaacttttatttttagggattttttttcccctttaaatcttatgagctttctttcaagtgaactttgaggtaaggattattaaatgatagagtaattgcctggttaaaaaagaatcagacataaaaaacaaatgcctagtgaccttccataatatcgctggataaccaccccctggataacagcctttcaaaaactgttcataatcagcacaacaagacaggtcatgtaatttaaaattaaaacctgaatcatttaatgaatagggatcagcatttttttcaatagtaccctcttcttacctaattgcattggatgaagataattttggagaagaaaatgaataaatgaaaacacaaggaactagataaatagatggggcgggtggatggggggtggagagagagacagcaagtgagagagagaagcttttggacctctctctccaaaaagccatttatgcttttccccattgcctaggggcaactgatttaatcaggattgttcatgtggattatctaaactatgaaaagcaacagggagcacttcccaagaaatccagactgggtgtgctgcagaatacttggtttggggcctggagctaagtagactgttcacattgtactcagggtcctaagaaaagtggctcagtgtctctgtaattctttgtccctttgatctacctcaacatttggtgtctcttggcattaggaaagctcacgaaaatgaccctgcctagttaacagattcatagtctgggcacacaaaaaaagggtaagaaagaaaaaaagctttggtaatgagggagagaaacgtaccttcttgctatctttgctgggcataaataaaaatcgaaagatgtgatttttggagatgtgaatcccgttcttcccatatttagtaatagccttttcagagccaattcaagaccttctatcaaccacctctgttaaacatatcaagttagatttctcattcattattttcaagctggattttgcataatcttccttcaaatgaagaagtttacttttcgaacatgtcatttgctcttagcactgttgttctccttcacccattttggcttcttatcctcaaatccctgattccttattaaagtggattgttaatgcagccattctttagcaccacagcacatttataaatcaaaaattagtttactctgcctggcttccaaaaccatttgctgcttgaaaccatttcatgagtttgtctactcatgtgaataaataaaaacttgcctataatgtgactttgggaaaggaaagagcaactatatgaaacgaattctacagaggccaaaattattttcacgagtttcatggattcagcccttgcatgtgccattctacattaactttatctctgagattaggattttgcttctctttttttttttaattatactttaagttttaggctacatgtgcacattgtgcaggttagttacatatgtatacatgtgccatgctggtgcactgcacccactaactcgtcatctagccttaggtatatctcccaatgctatccctcccccctccccccaccccaccacagtccccagagtgtggtattccccttcatgtgtccatgtgatctcattgttcaattcccacctatgagtgagaatatacggtgtttggttttttgttcttgcgatagtttactgagaatgatgatttccaatttcatccatgtccctacaaaggatacgaactcatcattttttatggctgcatagtattccatggtgtatatatgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactcacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccatgagtaggttgtgaaaattttctcccatgttgtaggttgcctgttcactctgatggtagtttcttttgctgtgcagaagctctttagtttaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactatgcttcataagtgaaggagaaataaaatactttacagacaagcaaatgctgagagattttgtcaccaccaagcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaatccacacataacaatattaactttaaatgtaaatggactaaattctccaattaaaagacacagactggcaagttggataaagagtcaagacccatcagtgtgctatattcaggaaacccatctcacgtgcagagacacacataggctcaaaataaaaggatggaggaagatctaccaagcaaatggaaaactaaaaaaggcaggggttgcaatcctagtctctgataaaacagactttaaaccaacaaagatcaaaagagataaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacaggattttgcttcttaagtagatgtcatttttctccagtaaaaccaagtggtttaccctgacatttagtagtaatttagtgatttcagagttccttctaaatctaaagtaaatgttcatgagactcatgaacttgtatctagacaattaatctgagcattttaagacttccctgaggctacatataatctctcacaaccccttgcaaaacctgagattttgaaccactgtcaagtttgtggttgccctggtaaggagtaaagcaaaatcattacttatggcaactaccacacaaacattgtagtgaactgaagtataagaaaatcactactatactttagacagaacattaggattaatgctggtaaccaaggaactaagagcctgtaaatataactggcttaagaaggagaacaggattaaacaatattggagtttagaaacaaaagtagtactgtatcaacctgtcactatgcagccagtcattacaataaaactaaccaaaggatggcggcagaaagaaataaaagtatttttgtgtacaattcttcttgaagcactacttgaattgcatctgtagggaacaggtctcataggtctattatttgcccacctccccaacacacacacacacacacacacacgtactagcctaggccgatatctactgtggtaagtttgcatctgtgagccactgagcagctgctttatatatgcagcataggatgaaagagagaaaactggggtactcatggtttttgtgtaatatcacaaagaaaagaaaacaaaaaaaggcttagagaaagttaaaggaaaatgggcagtggtacatatacagaacaagttaggattccctaggaactggtaataggactaaacttgcttaacatctatcaaaatgacttacttattccagggtcttgcatatacatagcagaagcacaattaatttttgctgaatgaataatctggaacaaggaatgtaaaataaattatccaaaaatgttgatggaatgaaacttttctgagcaaggaaaagctaaactgatggaacacaatatttatccaggtgtgcagaaaggtgccagtgcaaatagagaaaaacaaaatattcaaatacagtcgtttgccgtgtaatgacattttggtcaacaatgaaccacatatatctataccatggtggtcccatagattataatactgtatttttgctgtaccttttctatgtttagatatgtttacatatgtaaatacttaccatctactctgttacaattgcctacagtattcagttcagtaacatactgtacaggtttataaggtttatggcctaggagcaataagttatactatatagcctatatgttagtagtatataccatctaggtttgtttaagtacactctatgatgtttccacaatgatgaaattgcctaaggatgcatttctcagattgtatccccatcatcaagtgatgcatgtctagtttaattataagtcttacctaggaaagggacttaaaggctatgagctctttcaggcaaaaaggccttcaaaattttggcactcattaagtaaagtaatgaaaataaggtttataattcccttatattaaaccctctgcaattatgtgaaactatctgtacttcaaatgccatgttcctataacataacaactcagggtgtcttacacaggacagtcattaaagagtttaaggtagattaaaataatctgcattagtagagaacaaattattttgcggtattataacaattcattgaacatgagaaaaagcaaacaaacacgcttgttaataaatgttacttaacagacatcacactgacatttcttagtgactgactgccatggaagctttctaataagtctaatttttcccacgctctgagtttataagatagcaatattgtagctttgggtgtttacctttgtttatttattgggcggagttttattgcgtgcctcctccagctgtgccaatctggtaagatcaaatggaatcctttagctattgtcactatcctaaatggaccgcatgcttcctttgtcccttgcattctctgattttcgctgggggttatctatcatggctgtacatccaagtctctaatctatctcctttctcatccgtttttcctgacttatttcccttttccctttgtctatttccctgtgagaagccaaaagactgtatagttcttagtagcggtagtagtgctatctagagttggcatccaacagcaccagtgttataatacactttctacaatcaagaaatgatttgatttccttgcctcagtagaaattttacaagttaacagtggttcacctgatataaaccataatatttctatcatatcatgaaagaattctaaaaaatctgttagactttcttctacaagtttgcctatttcctctgaatacagttaattcacctggcaacaaaggagattagctatttctttttgtatgcagacagaaagaagtgtgatctttctttgccaataaaaacttctagtaagtggtgatagacttcaaaacccttctttttatttgaaaatcatggttcagttatcaggaattccaaattcagaatctaagaacagtgatcctatatagtcttgtgattttgcacatgctagggattggtaagttgctgaagacttcttaaataagagaggaagcatttttcttttcacttgcaaagaaccaggaggtacattaaaagaggttttagagtaactagaatgtgtgataaactgttcactttctgttttaaaactgtccatgaggttccctttagagataggacagactacagagaacgtggtgtctcgtttctatgggttgaaattccacagaacaatgctttgcaaagagtcataccaccagttccttttcctgtgagatgcaaatactaaaaacagatatgggctggacaagattattttaaaaatagatagaaggcaataaaagctttggtgatattctagattacatatgaaatgtgtaaaagcgtaaaatgaaaagttctctactttttaaaagctgcatcaaaatttccttcctacactgtaatcgtgccccttaacccatctatgcctgaggttgcaatttctttgaatttctgcaatcagaccatggcgatgaccttgagcagtaggatataaataactcctccatgcttagcgttccaataatggaacactaggcataaatgggataaaacacaaattgctaggttcatgataaacagagcacatctgtaaacaaaataacttttaaaaaatatgcctacatatataattttattacttctagaaacacaagtgttattagacttaaagagagccagtgaattgaatcaacttattctgatatgaacctcaatgtgatctgattgcaggctgcaatgattaacacgttttaaaagaaatgggtccatactatactttccaactgcccacccttctgttcttcttatgctacagatttatggcagcctaacctccagccaacaagttagagaattgggtaagacatcattttggctttttaagaaaattatggataatcaaaaaacatgacacaaaagatttagtggctattatcagggtataaactaataactaaaggcatttatgtgttaggtaataatgatgcttagaaaattataaatatcaagatgctctttcaacaactatattccagatttaggaattttgtagaggatatggcataagagtgttaagaaatgtatacttttttgaaaataaaataaagtctgatttatttattatccaagttcctgtgttttctgggaaaaatgtattaatgagaggtagcattatttgatagttaatggagagtggaaatcatctgttacaggcccacatgctcacaagcaaaataatattctctcaatcctcaaatggaaatggggattataaaatgctataagactctgtcaacatttctgataaattccatgaaaattttgtgttacatattttaaaaattgtgtactatgattataacatagttgattattaaatatgtaatcctttctttcagattattcttcttccttaaatgtaaagggtatattattttcttgatttattcttttggataaatatcctgtacatagatgtctgaaatccagcccgtcagtttccctttaaattctagcatattttaaaggaccttaaaagatgactgtggagtactgcctgatttggaacttgcctctgtctcttacacactgtatgacgttgggcaagccacttaacttctcagtacttcagtttcatcatcagtcagaacagcacaataatagtaccctgctcctatggttactatgaggattagtgggtttcatactgtcaataataagttgcctttctgggtctttgaagtacttgaaatcaggttaattaaattaagcagagctttggtccctttgtttgacaagtaatctccaattttcatttccaggttctgatcccctaaaatcagtggaataaaaccttgtttgtgtaactgccatcttcctgccccaaagccaagattaatttacctgttggttttagttttcactaggtctctctttagctaggtgcttctaagggtaaaatatcaactattaaactatttgaggcaggagatgttgaaaggggaatttaattgttaagtcaatagcagtgtgccagcttagtctgcctttcagaaagatcaccatagtaataacgagaccaataaataaataaaaagtataaaatatacatctatgcagaatcttagaaccctttctctaacacataagtcattaaaggaagctctgaggtctgcctatgtgattcaacatttacacacatcatagttctatggaagaaattctcagttgagagctaccagctttcttcagatcggatcagatttttctatactccattataaacaacaaaaacaaaagcaaacaagtgaacaacaacaacaaaactgtagttgtggttcactccagtaatatatactaccaattcagtggttcttaactgggggacaattttgccacccccttccccaccaggggagaactggcaacatctggagacaattttgataatccaaactgaggggtgctccaatggggagaggtcagaaataccactaaacatcctacagtgcacagaacagacatctaccctgcatcccggcaaagaattatctactccaaagtatcatagtgccactgttgaaaaaccctgtgctaaactaacatctgagagccactggccttaaaccatcagccacatcaacacgtaagacactcagcctatgggatagtctaacagttaaagaagacaccttagagggaactacttcaaaaatatataaactgacaaatctggataccatactaaggaaaaaactggtaaaacaggtagttgtttgaaagcttcttatgcccattattataaaccaataattttagattactgaaccaaccagactaatattccctttgaattccaggaggtataaaaatatgaagtcatcgactatgcaacattatcctgctatggagacattctgaaatggtttataaaagcagtgaacacattaaaaaaaaaaaaactagcccaaatgagttatgcaaagttaaagtcattttttctaggaccagttttttttcctgtgcatagtattttccatatgtaccgcaaacattcatttgtgcagaacatagcaccacatttctaatacaactcctctctgaagacaaatcaggctaaagctaagagttgcagaaccatttctgtatgagtcatttttagcacaacataagccctagagtaaaatttattttctaaataagccacaattattctgcaaacatttaacctagcacctctcaactgttaaagaatgtcaattatatatgaaaggaagaacaaatataaaggaaatttgaaaatcaagaaaattttttctgagaaaagtttgtgagaattattatgaatacagctaaaattcaaatatgtgacattttatttttttaagggtttccctgtcaaagacaacacatatttttctaatgaaagaggatgcctgaagttgacattcataagagcatttggatactaccaatgtgaagttgtacagatttactcatttctgcaattaccctcttgtgtttgaattctactttggttagtggtagcaagcactaaactgtactgagggcttcgcaaaagttgactttatttctttacacttagaaccccaaaaatttacttcctaggaagatactagggaatcatatcttactgaggaggaaataagaggtggaataactggattagcctcacaaagaatgaaagctcagtaatttctgagttggcaatatttttcaccctccttttctccatttaaatttctagatttaccttcaaaacacttgcctttttctaccttaagggaagttctaggatcagggagatggagatagagaaggtagagatagttttaggttttcacagaagttcaattaaaaactgccaagtacctcctaccaagagaccaccactaaaatttatttctagaacaaggtgcagaaaaataaaaggtagaaagcaggaatgttctggtactgtaaaatatttggggaaaaagtctaatttctgttctcaaaatggttactatcttgctctagagaaaaacataaaccctcttaaaataactgaagaacaataagaaacagtataattaagtgtaaaaatgggtggtagaagcaaaatgctgtggggcacccatgtgtcttacatctttccaacacagagaaaagagacaatgggtcaaatgcagcctactctagtctctgatattagtttcattacacagctataatcccattacaaagaacttgaaggaactgttgacattttttgctgccctggagtttattgtctcaagtattgcttgaaataccagggtacatgcagagatgtctgctctaatggtatttgttgacctacattatgttagggttagcctgaataaatggagaggaacgctacatggaatcagttagttagattgtttgtaagtaggcgtgcattatttttaccatgttttattatttttaacctaaagactacgcatttaaagtagggtattatctgtaagtaatcttgttgttatatgaaacagtaatatttattaaaagtgcttttgtaaagcccaaaaaggggatctgcagaggcagatttactgcatatttaatggagcttaaacctcagggaccttcacttgcgcagccccccttccaaggtcctgtacttaactctgtaatcataattttgtattctttttcttcaagaggaccccccaaatagtttaagcttctggtaaaatcttgatctagcctaggtataaaataatcttgaagggatccaaactgatagttctaaaaggctgatgctgagaaagatacaaaatgtgcttttacaaggatatcatatcaattatattttccaaatgtatctctcttattgttgtcgctcccccttccctgccaataaataaatgccattttttttttttacctcactgttaaaaggttattagacccttttaaataagatcggtctgttcagtgactgggaataaccagagtgttaaaaaaaagatgaaaaattcagaggcagaagataatttccaagaatgaaaagatatcttagagagactcacaaaatgtttcactaaaacagcaataattattatccatacctaaggagtacatgcatttgagaaaaggaagggcatggaaagtctctcaatacaatttacagtagtacctactgaaaactgtgctgagtttacacagagtgtgggaatttttaccaccagtaacaccacgtgtctgtttttctggtttctgaaaaccccaaataaatcccacaagcgcctctaaactccaccatggaattctcacacttctgagtaagaagttcagaacagaataaaaactttggatgcagtatgtctgtctatagtttttcctataatgccttgtcccagtttttgaagaaaactgaataaaaattaattcaagaaaaaaaatgaatgaaattacctcaaatggaatattaaattgaaaaataatagtcaaattgctcataaccacttcctgttaattttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgacttattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacagaaaggaaaataaagggctatagaaatcttaatgggcaagctccagatgctcaaaagcaattgtttagttactctacttagttatgcatcattcaaaacactttctaacaatcgggcaagaaaggttcctttgtgaagaacaggctttggggtcttggacaagttttaattctagttgttttatagctcatacaaaatagttgtggtgcatatgtaaagaggtactgtacttacatgcaataaagtttgcagatgaatattttgaaaatcaaagaaaagaaaacaaggggaggaatgagcatgtggtaccttgctctatttttaattattaacttgtagcctcaaagatttccatttagtagaaacacatgtaaactacaatgaaggagtactagaaaataaagtcaattggtataactcaaattattttgtaaaatgtgaaattaagctttaacctgtctatgtggaagggtgatgaataaatgaatgaatgaagtaaaaaatcaaagatacagagttgtaactgattttctttgcatgaagtagtaaatattaatattagaaatatcttttgatttagataaaactggccttgggtatataatacacaacactgaaaaacatttcaaatgtggtatttgtttaaatatatacatacataaacacacacatacacacacaagtcaaaaatatgggtgttctggtatagttttctgccttcaaagggtctctggaaaaaacagaagaaaaggtatcctataaactgcttttgctgaggtctctagtagagagcaaatcgaggcaagtgctgcccaaaataatctctattacaaacatttaaaaaatctatctttcatatatatatatgaatatatattatatatattatatatatacacaatatttttaatttttaattttattttatttgctgtatagctaacagcatagccaatgccctgatcttctagccacactgtaatttcttgtccttgcatcacaaccccagctgtagtcatcaaagtggaaaaactgacagcattgtctgaaagacacagcttgggaaaattgctccttgtagctcccctgtcaatgaatattatcatatttttctcatggataaggttactgtgttttttttgctgggccgggggtggggaggcttctacatacttagctactaagcacattaccattccgtttgtggaatggactaaacgtgacaatgcgagctgtagggttagcattcccaacattctgttttaaagtttttgtgtgtatatcttcaaaaataatattcctttatgtattcagaagaagtaaaatcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttagatatactagatgccattgtaatcacatgtattaactcgctaaatcttcacaactctaccagagagtactgttattactccgattttattggtgaggaaatagaggcacagagagatcagaaacttgcccaagatcacacagtcagtaagtagaggagtcaggattcaaacctaggaagccagactctgttacaggatgaatattttggttgctaaaggccccatcttccttacttctcctgatcctcttccccaactgatcagcttgcagcattcatttgatcttctcaacaaattacgtattcatttgcacaccgtccatttagaataacacagtagttaaaaacttaggctctggagtctaatatgagggtttactgccacatattggtagtgcttaacttttctgtgcctcagtttccttctgtataaagtagtaataataaaagcaatttcatgtatttgttgtgagggttaaatgagataatgtatgttggagctcaatggaaggtcaatgttctataaacattaagttcattattattgatttttatctcttaataaatagaatccctttttccaattagattgtttttcagaaaaattgtgaatatgaatcttttttgtctcgtgtaggggttcccaaatgttcagtatgttgaactcttagatgtcctaggtactactgaaatcacgtgtattaacattcataacaactctgtcaggtaatacttacatttacccataatattataaatgatataatataccaatgtctaaaatttagtgagaacttactcactggacaagtgcattatggcattatctcattctccctctaagcctctgaactaggggatttttttttttttttttttttggagatggagtgtcactctgtcgccaggctggagtgcagtggcacgatctgggctcactgcaatgtccgactccctggttcaagcgattctcctgcctcagcctcctgagtagctgggattacaggtgtgcaacaccacgcccagctaatttttgtatctttagtagagacggggtttcaccctgttggccaggatggtcttgatctcctgacctcgtgatgcctgcctcggcctcccaaagtgctgggattacaggtgtgagccactgtgcccagccaactaggggatttttataatctcaagtttatgcaggaggaaacagaagctcacctcggtcatcagctggtaaatgttcacaaatgtaaattcttaaccacaatgccatactacctgctaaaaaatgaatttaaggtagatctttagtaaatatatttggtcttgatgatgaatcaattgaattctttatttctgttaccagaaaccttgcacttaacaataaactaatgtggccttgaccagcagccgccagtccccaggcttcagacactggtacctgttaggaacttagctgtacgggaggagatgaacagtggacaagcaagcattactgcctgagctctgcctactgtcagatcagcagcagcattagattctcattggagcacaaaccctactgtgaactgtgtatgcgagggattgagtctgcacactccttatgagaatctaatgcctgatgatctgaggtggaacagtttcatcctgaaaccatccccacacctccagtccatggaaacattgtcttccatgaaactggtccctggtggcaaaaacgttggtggctgctggcccagacaatatcactcattctgttaactattgaaaagagatgactgtatgtcaggtacatgccaaatactggaaatttgaaaaatatatatatatacattgtgggtctaaaactgtatcattaaaagcagctaatgatttaatatcatttcatttactatcattttctgtttactcttacaaaaatcaaacttcttcctctccccttcctctctctgcctactctttcttattccttcttttaaatcaaagttttacagtattaaccttacaaagatttttgcccataagaaggttatatgttaaggcaaggaactgttttaattatatttactcttcattttgagtatatttctttttcatacctgacaaagacttttgaaatgactaaagaaaggcaaagcaatctgattctttataaaaaaatctttcatatgcaatcttttgtctgtagtattctcataatagcttagaaattttaaaagaaggttttagctggttttgttcttttcaaattggcagaatttgatttttttcctcttcacatttggattcactttaaaaatcaacaaacaagaaaataaaaacatattcaatttaaaaaatatgctctccattggtgccttggcatcatcaaccaatatcagcatcactctgaaaaccatttctattctgtttttaaaaaaaagagttttaaaatgcacacataaaatgcacttaaaattgatcctactgtattaaggagagagaaaatttaagggcaatggagagctttgctgtaaccaactcttcagtcaactataggatattgttaatactgccttcacctccacactgaagatataggtaccattttgactgtgcttttgaacaatatatagctaaagatttgaagtgagtaacttcaaagtcagtagttttcatgtatacgtcgcagaatcactgcatcttatgtatgactttaagttgtattaagctgataatttcaaaaagagagactttcaatgaaagaaaattcctgaaatttggtcattaaatggttcgagtacgtagaattacttacaatgtaatgccaaagaaaggtatattgtatttatccagaaagcacgagcataagaatgacctcagaaagttattataatttattacttcattaaagatacatttctagtccatctattatgtgctaggccttataatagacaacaaaaatgcaaagaacaacaaatgtgatctgaaaagtagtaaaggttagggaagatgggactagtaagagagaacagaagtaagaaaataaagtgattataattgtaactgccatgagctgagggcatatcatgcattgaggtaaggtcctaggtgcttaatatgaacaagccctgcaagacaggtatcataatctttgtctcacaggtggtgttgggaaaactggctagtcatatgcagaaaaatgaaactggaccccttccttacaccttatacaaaaattaattcaagatggattaaagacttaaatgtaagacctaaaaccataaaaaccctagaagaaaacctaggcaataccattcaggacacaggcatgggcaaagacttcatgactaaaacaccaaaggcaatggcaacaaaaacccaaaattgacaaatgggatctaattaaactaaagagctcctgcacagcaaaagaaactatcatcagagtaaacaggcaacctacaaaatgggagaaaatgtttgccatctatccatgtgacaaagggctaatatctagaatctacaaggaacttaaacaaatttacaagaataaaacaaataaccccatcaaaaagtgggcaaagatatgaacagacacgtctcaaaagaagataattatgcggccaaaaaacatatgaaaaaaacctcatcatcactggtcaatagagaaatgcaaatcaaaatcacaataagatactatctcacgccagttagaatggcaatcattaaaaagtcaggaaacaacagatgctggaaaggatggggagaaataggaatgcttttacactgtttgtgggaatgtaaatatagttcaatgattgtggaagatagtgtggtgattcctcaaggatctagaatcagaaataccatttgacccagcaatcccattactgggtatatacccaaaaaaattataaatcattctactataaagactcatgcacacatatgtttattgcagcactattcacaatgtcaaaaacttggaaccgacccaaatgcccatcaatgattgactggataaagaaaatgtagcacatatacacatggaatactatgcagccataaaaaaggatgacatcatgtcccttgcagggacatggatgaagctggaaaccatcattctcagcaaactaacacaggaacagaaaaccaaacaccacatgttctcactcatacatgggagctgaacaatgagaatacatgaacacagcgaggggaacattacacaccagggcctatctgggggtctacggctaggggagggatagcattaggacaaatacctaatgtagatgttgggttgatgggtgcagcaaaccaccatggcatgtgtatacctatgtaataaacctgtatattctgcacatgtaccccagaacttaaagtataacttaaaagtttttttaaaaaatatgtgataaaataaaaaaaagaattaaccacagtgccttgcctattcttctataacagtatctatttcactctattttattttgaagctatttatctccaagtttctttctagaatctaaacagttaacagcctgagggcattgaccttgactcttgtctaagttttacaaacaaacaaaccaaaaagcacactgcattgatatacttggccaagtaatgatgtccaaatgctacaatgtcacaaccagtgctcagtaactattagataaataagatagagtcattcactcaatcattcactcctgcatgtttcacttagtaatcttgtacgctcattgaataaattaaaagctgctttatgaaaatgttttctgttaatttgaataaaaacctttacacatcaactagatacaaaagagaaatctattgtttgacaatgatcgttactgaatcaaaaaacagtggggccatctgcagggtacagatcatgctagagtcagggaaaactggtgataaacttcagaaagccaagaaatataccagcttacaacttagcagcactgcctccacacagtcttcaggtatttattgactgtctcacactaatgcatgagtgcctgtggtaatggtaaaagtatataaatttacttgcccagagatactaattgttaaaacaaatacaacaatttaatggcaatgcaagagaagacagactaacatttacaaagctatttcttgtttaggcaagatagtagactctaaacatatattatctcatttaaattatcatttaaaaacccttagattgttagtatttacccattttaattaaaaacataactgagcgtataatttttttttttttttttttgagacggagtctcactccgtaacccagattgcagtgcagtggtgcgatcttggctcactgcaacctccgtctcccgggtttaagcgatccttctgccttagcctccaaagtagctgggactattaggcgtgtgccaccacgcccggttaatttttgtattgttagtagagttggggttttgccatgttggctaggctggtctcaaactcctgacttcaggtgatccacctcccttggcctcccaaagtgctgggattacaggcgtgagccaccacgcccagcctgtaaatcttgacaaaattcccagaggcaaaattattagaaggctgggagccaggattaaaaaacataaaatccttggcttttccatttatttcacattgcctcttcttagaatccacttctacaccaaagcagttaaaatcaatgtggatttgtattttaatagagggtttatggagtagtgggaaagatagcaaataataactatgtttattgaatactactgttcctaacattttgaacctatccaatcatttaatcctacaacaatcttttggaagtgagtgctattattattattgccactttgtaacagagaaactaagccaaaaagaagataaacatttgaaaagtcataaagctagttagccgctgtgcagctgaacttgacagcctatagcccacagagtttaaccatcatgctatattgcttcattaggttgaaaggttattaaatgaaatggcttaaacaaagttctaagcacatggcatggcacagagtaggtcttcattaaatgttagtttctgttttttctttaatctctaaaattctataataataatacctttattttcaaagtaattctgctttttaaagactttatgacatctgatttaaatttcacaaaaaaaggatggtgaatgtggaataaatcttcacaaaaatgacactgaagattatttaaaggcatagaatgttactcacaacacagatttaagagacaaaagtagaaacagtgttcacagtgttttaccaaaaacaaaaagggtatatatgcacaggaaaaaaaatgattagaaaggtatatccccaaagtttgaaaacaaattacttctagacgattgtggggattttaatcgtcctcttgtaatttatgctacgcacagaattctacaatgccttttgtatgctttctatactaagaaaaaataaaaaagaagagtagtactccttttttgagatcataatactgaggggggagaaaatcagtagaaatgtgtgagatttcaccctcagtgatagagctggaatagaattcgcactcttcatctctaacctactgtgttttatctgacccttattttctattcagtgcttaccataattgatgaattcaaaactaatctatgatgaaaacccctgaaagtgattagagagactgtgattgtaaatgtggtatcaatcactaacacaaaagtcccttataactcatcaggcttcttaagttgtttattcaaaccatttgtttctgagtccaaaccaataatatatgtgatagaccggattactttctctaattcttcactccctctctataatagaactttacatccataaactttaccatatgacttgaatgtaactctcagtagagtatgtgttaatgtgggagatgggatatatatctctgtctcttggctttgagcttggttaagtgacttgctttgactaatgaaatattagtaaacatgaaatgagcagagactttaggtattttctgcgggaacaaattctgtagttgtcaatagtttattctcctagattaaatgtttgataaacttttctaaaagaaggaatttttttttcagagagaaatatagctaacatggaatatcatgtccttttgtacttacctggagccaaagtaaactacttggaaaattaaggtaccttttgctggactattcctcatcctttagtttcttcagtccagactgggacattttggttaaaaaggagtaggcttgtgatgttaaggtgatcatcttggtcaccataccccagaaaaaatctttacatatccatgtcttagacactgaggtacagaaagagagttctgaactttccattccattgtcatttgtgttgtggagtcttattaatctgtctcatggaaggtgggaatcaggctatgaatggacaataattcatggggggcagtcaacagtagagaagaagttgctgcaaattgattaatacaaacaaaccaacctgagtacctggctcattttaggttccctccaaaggcttcagtacaggcagtaacttagaaggtaatctcagagggtaagataataataaggattgacaataataaggattggccaggatctctgagatttacacaaaatggctccagaggtagacattataaagaaatagaggctagaacatctctttttccagctctattcctcctttagttgagagtttccccagggcattaagccctgggggcttaatgtaagccccactctccccatcctagattttttgagatctcccagcattggaaaaggtcctggggcagaaggaaaagcatacttgaggtgggagtctgggttagcagagaacggcttcaggtgcagctgaagggaccatgacagcactgcctgacatctctgagggactatgacaggattctgacagccatatctgctacagaagcctgtaaagacttggggtggggggcagtggtgtataatatactgtgtagtctgatattgcatcctttaaagtatgatctggggaaggttaggctgcatcttctttattaaattatattccaaacaagttgtctcctctgactcctgcatgaagtcagactttgggacagtaaatcctacactgtccagctaagaaaaatgacatgttgttaataggcttaactgattctcttgctatgatggcaagatcagatttttagcagtgcttctgaaaatcctgacactcattcaccaattattttcttctaggagtctaatatgtattcatcttcccatatttcagggaagaaatagttgaacgactttagggagcttttcccaaaatgctgacgcatttttgcagcattttgccataatggggcctattgaaaatttttctgacattctgaattcatagcattaagatttgtggtgttgtttttgtatctggtttgtatttatttttgtttttattaaaatacaggagaaattgggacaggttaagagttgcacctaaatgtatgaagcttgaggtctttgaacataaatgagttagatatacagaaagttattaagacctttaagcattcgtaaacatttcatcattgctgacaatatctatttactttaggtaaccctgcctgagcagctcctgcattgctacaaggatgaaggtggggttatttaaaaatttaccaagctgtgaaagagttttctggagaaaactggtttggggactcagagcataaggataaacaatggatacttttatggttacaggagaggagttgataaacccctcattcctctaatgtaatgtataaaagaaaatattgtattcctggtcctcacaaatggggaggtggtagggtaggtaggttatatgaacacacatgtcttccctttgacaatgagtgggcaggcctttaaaaaaaagtctgaaaaaataaagagccctggggaccatttaggctctatcagtgagttctatcctgagatatcaaatccagttgcacagaatctaaatgtcaatatttacaaagctctttccatcttatatcccgcttcctttttcttttatgctctttctaccccttttccttcctccctattcccttgatcccctacatcattctgttttcccatttgctctcatttcctaacaacccccatccccattagtcagtccaaaatctgttcatcccgctataggcttcagtgatggaaaagaaagggccccaaacaaagccaccatccaagacaaggagctccagagggtggtgaattggtgattgaggtaaagcctggggactgagaatgttcaccgctctggaggttcttagcccgaaaagtgattaggcatcagcaggcttgatagctgtatcaagcctcatgatttcaaagctttcatgagctgacaaggacttgctaatttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtaggaacgctgtcttgcattcattcagtccattaatttctgatggtgttaattaaaaacttttgatgctggtttgaatggaaaatacctcaaacagtgtttcctttattgaaacaccaagttccaagtcttggattattaggttaagctctgtcagtagtgagaccaacataaatgcttttcataccgtatgctttgacaaaagagaatagtaataataataaataaataaatgaaaaggaagaagaaataaagtgtttagactgaaaactcctttacttcaccaacctgtttttttaaggactaaactaaaaatccaggtccctgaatgtagaacatataattttaaaaaaatcttttttcaaatctttatagaacattcaaatcacccaatgttccaggacctgaattttttatattttaaaatgaagaaagctgcttaaaataagtgaatcagctgctaagtgatttctctctgtcttttcctctactctctctttaaaaagactggaaaatgcttaaaatggtatatgcaattgatatgtgcagcttaaggagcttaatataattactgaggactcagactttctatttaaaaataagatagggtagggtaacagaaactctgagtggtgagtattcatcccttgtgatggtgaggtgtgggaaatgtttccaaatgtttaatccactgagcaaggtaaagagtgcgaagcagttattcacagaatttggtgtccttctgaaaacctagggaagcctaggaaatccagagaacaactgaggaggatagtatgagagatgctgtgcaggaaacaagcaaataaaatatccatttcttcaatccaatgcttttgtgaagtattaagccaaccaccaaaacattctgattgatttttaagactcttctctaattttattttttaattactcttccctttgtgtattggggtctgaagccttgggcacccattctgagaggtcttgtaaatgtgtctcacatatgcccgtttctcttttgttttctaatatacctttctctatcatttttcatttcccaacctgtttattcacactgtctgcaatgtcatctgaatcctcgaaaaaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaacaggataacttcagtgtaaggcatgtgagaaaaatacgcagagtaatagaactaaaactccatgagggaaatgggcctgagcaaaccacagcatgggtctttttgttaacaaaatgtatgatttttccccagagtacattgatagaggacatagcctacaaaggaccagtaaatgtaaattaactaacagatatgtagcaaatgaatgcatttaaagatgatttccagctgaaatgtttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaaggtaaaaaaaaaaaaaaaaagaaagaaagaaatgagttcatgtttgcctgtcacatagtttgttgaaataataacaaataaaccaataaatgtttattgaaagaatgacctggaaataattttaaagatccacttaaccccttgggttttatttgatttaaagaaaattgtgagagttctgattctacaaagggctggataagtcatccaagaaataatacaggctcttaagagtccactaaacttggatctccaaagttcttaaaagtagtttctgtttctcctttggctccagatccttattatcaaaagatgtgacgagaaatcaaagtcttcttagtggccgggcgcggtgtctcacatctgtaatcccagtactttgggaggccaaggcaggtggatcacttgaggccaggagtttgagacaagcctggacaacatggtgaaaccctgtctctactaaaaatacaaaaattagctgggtatgatggcgcgcatctgtaatcccagctacttgggaggctaaggcacaagaatcacttgaaccggggggacggaggttgcagtgagccaagattgcaccactgcaatccagcctgggtgacaaaatgagactccatctcaaaacaacaacaaaacaacaacaacaaaaaaccaaactaactgttcagtacatgctcagtacttgggtgatgggatcatacataccccaaacctcagcatcacacaatatacccaggtaacaagcctgcacatgtatcctctgaatctaaaataaaagttgaaaaaaaaaaaaaagaaatttgtaactgtgtcaagttgtgtttgacaccactttatagaaatggatttattcttctcctctatcattttcttagcaaaactgaaacacacttctagagtgcaggtcttgatataatcagacatgagaaaatgagaacagttagagaaaatacaattttgccattgtaattacctcttacaaacagcctttcctctttcctgttttatgtgcaatgtgtacagcaacaacaataaaaataaacaaagacatgattaaccgatcaatttgtttctccaaagagagaaatagttaagggctaaagtgcctttcaataattaattataagagtctttaaacttagtattgagaggttacagatttccataccacaaatacattaggttgattcacagagtggccatcaaatacccagaaagcaaattacttttgaccgaaatgtatacatcaacagtacggttaggaatgttttcatagaggaggacagaacatacataaccagttctctatggagcctagcatagtgtcccatggaccaatccacataagataagaccatctacagagcatattcttcatatcacagactctaggtaagaagaaagtattctctaggtaagaggagaaaaataagtgaagatttctttcgttaacacttccaccatgaaaggaatgagctgactacagaaccattttcttgaatatttttgtcttgagtggggtttttatccttccttcaccactctaggtagagcagaatcaccaaagttctctcattacggtaatgtcataaatcccatcctatagcagttgtgcatgatcctgtgttatgcatccaataaagtttattcagaaaatatgtcagcttcattaaacagggatctgatgatctgaacaaaccacttatcttgcttttgtgacatgtattggtatccttaggtctaaaatgaaaatcttggttggtgggggtatctgccaaggattccctgcctcatgtaagcagaatcatctaaccacaattctgagcttaactgggggaaaggaggtggaaggtgtatcgtactagttcgttctaagaaatgtcttatagcttgaggatacgtgaggtcacaaatgtaacaacaactgaactagcaccaagagccaaagaggccaagcataaggaaacctgaagcaagagaaaaaggtgtacgcgtacatacaccaagaagcaaatgctatcattaataataattattgttattacagctattagaatgatgaggcattgatggttcacttgggtgaaatatataatacataagctagaaagaactgtgggtaaacttatggatctttttaaaaggcagtttatattctaggtttatgtgatatgagacacataatttaacaccacatataagaacaggatgctgaaaaaagtgaagaagacttgcagctttaaaatagtataatggctagttcctactggtcttttcttgtgacacctgccttagtcaagccatccgatatagttctaaccttttctgatattttaatgatgatgacaggcccagagtaaaggagacaaaataatcagaagattcagaggggaaaaagaaatggaaagaaaaaaaaagagtttgtattgtttataccatctaatctgacaaattttatatatgctctctgtttgctcaggatagtttattgctaatgttatgactttctcttttttttccatgtgctttgctctaccagttttggctgaaaatattttgtatatgtccatactgtaaaccctcatatttttctagagatttagtgtggtggggaaacttttttttcttccccaagggttaggcacatcaatattctagctactcacttttgaggccaatggaaaatgtgctcctaagattaaatagacctgagtaacacataaattcagtttatactgatgcagtatgttgcatagttacatcctgaatttctgatgcgtgtaatacacctgttggacaacacatcactactgaatagtcactgacctacaattcaaagacagtgagacagcacaagactacagatacaggttctctacagacagcctgatttgtacagagcattcctcatctgtggaactctgtgtgtaaaggatctaggctagccatgggaagctggctcatagagggttctaaatatttttagaataaactagagcaataatacaagcacagagagcaccctttgttatacaatgcataatttctttccccccaaacatgttgtttaaaaatgattcagatttttattatataattcccccttttacatatttctaaatgcctcacatacccatcacatgttttccatgtctgccaataatcttaattaaaaattataaacttttaaagccagtgttacatttgatttaagtagatttgccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtgaaatatttctctaggcaaccaaattgccctgtggcttacagatgtgtctaagaatattaggcaactcactgatgagattttacaatcaactgttacatgttagaaaatatgatgtcaggatactatgaagaaaaatactactatatacaataataagaactatttatctgaatagtttttaacattaacgtgtaaaaaatatcctgatggatctgaaataatgatgtactaaatactacaatgtctggggtttgcttcaacataacatggtgatatagtgagaaaataacaggccatcagttagtcattgtgcaagctggtgatgagtacatgggagttcattatagtaatttgtttatattcatgaatttaagattttttatcataaaaaatttaaaaacatatactgatttgaacttttattcatttattatttgttgactgattcatttactgtttatgcaaggtattattgagatataaataataataataatgctcttattgggcatttaggttaaatgagctattcctcttcaggaatattatatatttattttaaatgtttataaggtctatgtaattacatatttcttaggttaaattttgaaagcaggacacaaaattatatagaaagtatgataacatcatgttttaaaaatatatcctcggggaaaatgagagtaaggaaatatatcaaatggttattaatgattggatttaaattatagaaataattactttaatttttcttcattttactcctatgtgtttttctaaattatttttaatgagcatgtatcattttaaaatgaaaataaatatttcttcattactggaaaagatatgttctccttccccaaggagcttttcatttactgaaacagagaaactgcaaacacacagcattgcccagatagtttaaatctccatacctagaagggaaatacacccacaggaaaagaaacgtcaatacagattttatctgatcatagaaacataaagagctttctctgtgttggacagcaatagggaagaaactggcttgtttgcaagccagcaaaagcgtgaaattcagtcctttttgtgatgagatcattttgtgataaatgcaaaaggagtgacaaattaaagtcaccaaataagcctttcccttgagctcctgaggcttactaatacgagtttcttttggggtagcatagcaagtaaagcgtgggagtggggagggaggcggagctacaatcccgaaggctcctggccttcactggtgagatggatatgctcagagagacagagatagatgtgcaacagaatcagaaacaacaacacagtgacaactatggattatgcacaatggatatggaaagtctctgttagaaaactatctttattaccccaagagattatttccctcagtttatgcacgttcatataaagcgaagtcaagagtgtaacttttaaaggtttggatgaatatgatgttcatgactaaacaggcctagatggagccaggcagaacacagttagatgccagggaagtcacccttttcctcctcctccctctccagtacagttgccagtgcatttcaatgcaggtcagcctctagcaaagtcagctgtttcaagctctgattggataatactttatctatacacccccagtcttgacctgcactcttctcccagtcatggaaatatcaagaattctagaaggccacaataccaatctttttgaaactttacaaactttacaaattttcactacaagacacctagaaaaatcttcaagcctatgcttacctgtagccctggtcttggtcctcttacttaactggtaaaagaggatagccttatttatgtctttgaagggtattttccttttttgcttgttggtaagtacaagagcaaccatgtctaattttaagattgatccaaatgaagcaaatgcatttcaaatttacagaataccatagaatactaatgggtagttcaaagtatcactaaatgtgtttggagggttttgagttttttcaaaacatacaatgttccacacaggaaacatcagtgccaacttcaccctatcactctttctgtccactcaggagtctcctttggaaatatatctctctggagggtcttccaaacaaatcctttgaatacttccatcttgtttagcagagtattctaaaatatttgtcaaaatctgtgataataggttctggagatcatgtttcttattcttctaaatgctggtatttcaaatgaacaaataggatattaaagatctgtcctttaccaatgtcaaaatatgttctgtcaaaatttagtattgctaaagtttagacccaaagactcaccacagcctttggatctcatattttctgaggttcatggaaagatatttgacttctttgcacctcaatattttggactgccatttagagataatgagagttacttaccagacagcaatgtcatgaggaatatcctgttagtaatgatgaaacattctgaaataaaaagagtacaggtaagtgctaggtatttattttaataaatgtatgataacatggtaatcatagaaaataacccatttattcctcactttgggatactgactaagtggtagtatataaaaagtaaaggatgtttccctttgggaatggaaatagaattgtgcactaagaaagtatcttttgtaactgcctgcatgtttaactttaaggtctctaaccagttgcaaccagttatgaatgacttgctgcccatttctgcaattcactgtaacttgtgttgagaaggttatgttttatggttaattatccatggtctgtttaaaaaaataaatcaaaccactgtaaaccactaggatttgcagctccatttgagctttactgtagttttgatcaaacattttgtacataaaaacaagctggtttctctttgtttttagttgtttgttatttgtgttataaatattgtggcaatggtgggagaataagctatggattatttaccctcggtttcatgagttgtgagttattggccttatcctcctttataagtataaataaatgtataatattatattccaagtcttgtaagacaaatggaacgagtgaactgaaaccttttagacccaaaatcttttatgcgaagtcatagaacaacaaaacaaaacccaaattaacatttaaaaagcttctactgtggagcaacaaagtctttaaatattatataatctgcatttaaaaaactgctcatctaacaggcagcagtctatcattctacaagcttttcaatgcctttaacattcagaagctacaggtggttttcccaaagatcactcagcacccccaatatcactaccacaatgaaagccttgaaaatggccagcatgattactttaagccaaaatggatttagaaaaatcaggaattcgtgtagctaaaagtaatgaaacactgtataaaagaagaaccctatagaattttttttatagttaccatcctaggacttatataaacaaaagaagtccaaaaacaattgtccagagaaaatgagaaaagccaagattcaaaggaccctgtggcagagtgcatgaggagcatactcgatagctagaatcataagtatctaacacatttgcatatgaaacttaatgaggatcaccaaagtagcttgccaaaaattatgtttgttaaatcagccaacagtctatgtagcacagacccctaaaaagaacctctaggaaagatgtaaaattgtcttctgaaatttgcttcttttataaaggcagaaaggataaaaaggcctttctcataaaatgaagtgattggtccactactacagtctgaagagttctgtatcagatttcttcttaccctttattacttgtatggcttactgcttacctgcatcagcagtctgcagggttggccatagcaggtcccttacgagttcactgaaacacggaaaatatttatgatggtactattatgtgccagacacaactggatggattctgcttgaaaaggtaagtcagtaactgaggttcttgttgccacattaaaagaaaaaatctatccctactgccaacagcaataagaagagaagctagggtgaaagagttgtcaaagacttatgaaaaattcgaaactgtttaaaattctccctagcttcttttcttgcatgtccaagtaacagaaagcttaggcctgccacctgtcttaagcctggatcccatattaaaaaaataaaaaaaaacagaaaaatgagaaacagctaatgtgttcccaaggccttggttacaacagaaaatgagagccgagaagtctacattggcacacatcgagatttgaaaggtcagtcctgccctagtatggttcagagaccgtgaaaacccaccaagatgaaaatggaagctattctgacaacaagaggcagggaaaaagttcaaagacttttcctctgcttcttttataacgagatactttcaactatttttgacaatcaataaaatgcaaatctccctcacttttgtgttctaagttttttttttttaaatttaaacaacccatttgaaaattagggtactcagaataacttcttgtatacagaactacacatttaaaaagctttgtgcagattgttaatcatattaaaattacatcataaacaatgcactttacatggtgcaaatgttttatgtttttttcttttgacaatcaggcacctacatgcaaaactgcatattggaatccaaactcaactataatacatgtagaggaacccttagaaaaatgcatgtgggaatatgatatcccagttagagactagaatattctgaccaattttcattatttctctgtaataaatttatctgagctatagatcctgttaagaaaataaagctaaatggaaaagtattgataaaatacattaaatatatatatactagcttagtcattattcatattaagatcagaaaagatttccgcaagtcatcacaaatacagagatgggataataccaataatctcgatcacccagttgttaaaacagagaacctcacatttgggcaataatagttttgatttttatcttgtgcaccagatttttccatacaaaggaattctaaattgcaatagttaacacataagacagtgttaaacaaattcataactttagtaaaattaaatgaaccaatttcttatggctttaatatccagaagtaaagtatgatcttaaagaatgatgctgatctgagatacaaggagatcaagcgcttcaatagttcctcctcacacactaatgatcgcatccatcctctcttccacccacctcccaccttttctggttgtattaaaaacaatcaaaactaccaccactgctgctacccttcacacacctgaacttaatttcttctaagagatgcctaacagtgcctagggctgtgctatcactttatatccattttatgaccgcttgagaggcagaaactaaaaaggaagaccaaaacaaaacaaaaaatccctccaacctcccttatcagacaaatgcctggttcccagaggacaccagtcagttaagcaaaaccaaatattacaacagggatgaaggacttataaattgcatacaaatctcactgtgctcccacttaaggtggaaagggagttactccaatgaaagaaaagggggagggggttgtgggaaggagcgaagggctacagaaagagcgagagaaaaagagagagagaaagagagagatttattgtacatttgagacattaagaaggcagtacagtgaaaccaaaggtgttccagggagaaatgtgacagaaagctctaaatgagaattacagaaactattccttcttaaataaaactgttgtttagatgatgaattctataggaagtctgaattaactgtctctgttgtagcatctagatgttttctctttcattaagactttggagtttgaatgtactttgttaaaaaaaaaaaaaaagaagaagaaagagaaaaaaagaaaaaaaaaaaagcattagagctttatatagctcccaaagtaaaaagcaagagaaagatgggtttatataactggcttttttacataaatattacatcaggatacatttcaagtgaaaacacacaaacacacacacacccgtcttccttatactctttctattttaaaattcatttcatactttaaatgttgttggtttttcacaaaataagtaaaaacgaagtcaaaacatctcaaaataagttgccttatattacctggaaaattaacccatcatacaggtcacgatgtctcatttaaagccagttaaggtgctgacaattatgggacattttgctgcagcctagggcaactagaaagggccatggatgttaactaactcccttttaaacagtctgagaaaagggaaaaaaaactgtaagtttccccatctgttatttccttttttttttctttttggctgtggaaaagtaaaattatgcaagagcttttgaatgtaaaggctgtgtgtgctttttccctttttgtctctgtgtaccggttaagtgatgttgcgtaactgagtacagagtaggcggttagcgtttactattgatttacactatgccatctaatgaattcagaacactaaaaagaaaggagcaggagagggagggaggaaaaagagaaagggagaaatagggagaggaaaaaataggaatgaaggagaggaagaaagagcttattcagagaaacagttctaatgactggaataggttcatttttattcctatagctctgacttttggttattgttcagctctcacaaaaaaatggtcttgagctggtgaccccaatattccaatcctatttctaataaggattactggcaggtgaatgcctgaaagttctaatgtgtcaaattacttgaaaccaatttcactatactgtcagactcctccatatgcatctatttatgattctctctatgcatttgtgaatctgtatctgtgatcaccatggatttggtcctactggcttacccaatcaaaaatattatttgaaatatatcacgggaatgtcatcagggtaaagagaaatacattctattttacccatctcctttaaaaatacataaagaacacatttagaactttaaatatatcactattttactttgaaaacagacatgctacaaattgtttggctgaacaaaacagcccaatataggataataaaagagaaataggcaaaatgaggaagaacgctaaattgaggaacaatattcataaagaaatttaaataatttcttatgtctatggagagccttttacttttgtttgggtggaatgcctgtagcattctcagtctttgaatgctgctcagtgcttcccatgccatataatgaattcccaaagcgtggaccagaaagaaagggtgaagttgtttctgctgctaggtacaggtccttcctgtacctgagtgccctcctatggctgagaacaaccactaaggtgagaaagagaaagagaagttctctttagtaatcagctgaaaagctgggcagggaacttgatttctccctcaatgtgtgtttgcaaatgatgactgggaaaaatcacaggaggttatccaaaggaaagaacaagagttggggtttctagtcatccagttgtcttctcttttcagccatctgagcttagaaaatattaaacagatgcgtactctgtccacttgtcaaagatgctttaatgacccatggtggtatgcacacagttgtatacctagcacttgccatggtgcttggcacattttctatactcagcaaatatttattgaaactgaaaaatgatgatgggagaaatatctctgtagaaagaatgcactagaaaggcctgaaaaaatatattccgatgttttacaagaaatcttaggctatattgctctatcattaatctgcacacaaaataatactgtaagagaaatatcaggcagttatttaggggtcagttgacttcagttccattttattaggaaaaagcttaacaaaaattataatactgataacatcagcaaagttttgtgttcatttccaccagcccttttgggctgtctttcatttcagtcttgggcacagaaaagtctattttaatttccatggacacattctaaagaaaaagtcatgggatatcaacgtaattcatcttttaaaaaatactgagacaaatgtagccatttagtaatggaagagaatatggctttttgttgaagggcaaggcaggtggagttttgattaggttacacaaatttaaattactagaaggacaccaagaatgtactgatttccattttcttggttaaacagtttttttttggaaaaaaaaaattctggtttagaaagtcagaaatgccatctttcagttaattggagaataagacctttagaaaaagaattgcaactacaatttctcaaaaattccagcgaagattcaacttaaagcatgtttagcaatagtagccatattcttttaaaaaatggggctaccatcttgttaattctgtaggactgagcatgtagatattagtcaaaaccttcaaaaagttttttatttctctctcttggtcatctatttaatgtaatcggattcagcaacttccttcaataagcattctggcaatatgtcaacaagatcattcatttcatgattcttaaaagtggatgagaacttacctgttcttcttcattttatatatgaagattctgagactcagaattaattttctcaaaagcatatattttgaggcagagctgggactagtatctaaagctcacagttcatttttttcacagcacagactaaatcaaagttgtataaattcaatcttattttaaatgccataggggaagatttcaaaggattcttttataagacaaggaattcttacattatgtaaaatgttcacctcaaagctatcttatacttttttttatcttaaatgtgagcctactgttcaaattgttgcttctccttttccttgtcttaatttttgactctttagagtctttgcctcctgtcctctcacttgtactctgtgtctagttcatatatggcccttcctgacttcatattcttccttctctctctcttttcatctttttatcaaacttttatttattcttgttcctcacagaaataatttccttgttaatgtgatatcctcagaaactacaaaggaagaaaaagtgtaaatttagtattattataataaataggcctttggtttatatttaaaacaaaactgcaataagatattgacaaacagagtaaactacagctataggcttccctatagaaagttacagctgtctagacctccatattatcaatatgaaaacttgggggctagcatttcaaagtatctcatcaaagacagagagcaaaggctcatgatctccagaccactcattttccactacatcaggacacctttcgtttcccttttctttctttccattctacattattgatatttgagactgattacggcacagcaggaggagattcagagaaatctccttggcttaatgtggtcaaactctctcaattccaaaaaaagtcagaaagacctgcacactaaaattgtagttacacagaaaaagaactctgaggaggttaaaagagtcctctgacatgagaaagtagtctctggatagcagggacattgctgccaaaatcattgtaattaagattgggtcattgtttccattataaaccttatgcttatggggtttgtaattcagttaaaatgatcagctgtaggctgaaatgcagccccaagtatcttagagtgggaggtgtttctcccctcctatttcttaaaaaagaaaacacatagcaactatttaataatttcaatgagagttgtattctgacccttcccctacaaagggtagttaatcaatgagcttaatctagagtgagccaaggtgagcaacatccactgtggaatgaagcacattaacctggcatatgaatgggcaataaaaggatttcctattatttcataaggtttaatgtacatcactccattccactgtattgatgtgaataggctttcagcaacaccgtgttgaaaaatctcccacttctgtttgttaactcattattgtaggaaacattacaattataggagacaggaatttctgatggtttccttagatttctttcctcataagctcattcccagggtcagtattagataatcaataatttctaaaatttcttgctcctatttctttagcattgtctacaatatctgatacctatagtgtaatgctatgtgccaccatgatgtagagggattggggaggaaatcatagctatatattaaaattaacaggccagaggaaactggtatttactgagtacatactacatgacatatattccattaatattatttcatttaatacaaacctgcagtgaagtagctgtggcccatgttttatagattagcaacatagttaaagagctgttagctaacctgcgtaaggaaacagagctaatttaaaaagttgcgaagtgaggtttgaatcaagatctgtttgactcccaggcccatatgtactgcaatgcaatgcaacaccaggaacagaatatgaaaccatctaactgaaaaaaaaaagtctccatgccaatgatgagagctacctcatgctccaagtaggaggtagaaagggtaaatgactcctaaaaagagattcttgctttgctcttggctctgataaatccctgtttattcatatgcaaatatccaaatgcatatttggaaaatgttttgtcttagataagaaaatgcacaatctcctagaaacctttaaatgagaccagacatttgaatgtttacaaaaattcctttgaagatttatattaggagaaagttttaaaacataatgcataaaaaaaaatcagatgattggctaggcatggtgactatcgtcaccatgggagtcgctttgggaggctgaggtgggtgcatggcttgagcccaggagtttgagaccagcctagacaacatggtggaaccccatctctacaaaacacagtgaaaaaaaaattagcaggcatggtggcacgtgcctatagtcccagctactctggaggctgaggctgaggctgaggattgattgagcccaggagaccgaggctgcagtgagccatgatcgtgctactgcactccagtctgagcgagagaacgagaccctgtctcaaaccctccacccccaaaaatcagatgattaatacaacattaacatttcaatctggatgtgtgtgtttgtgtgtgtgtgtctatgtgcatataaacctataaatatacacatacacagatgaatttttttgtctttgtcaaaatttctggtaattattataaagtatttgacaaaagctaaacagtaaatatgttacaccaggagaaaaggaaacaaagaacaagaaaagaggagtatgtgtatgtacatacttccctcagaaatctaatcctaaaacattttttaagctaaatgggacatagtgctttagtctaaattgtgtgtgtgtgtgtgtgtgtgtgtatgtaaagataaaggacttttactatgttattttggcaagtgattatttttctaaaatctttgctgaatcgttttatgtagatatactataatactcttgaataaataaatacttgttcaagttaaccttagagctcatcaggtaaataacagaatttaaaaaagaatctgtagtctgaaacactgtagagtatgccaactttacacattacattaagtattcgttcaaaataatttataaattgaaaagtatactccattttattcaaacaatgcaattttttaaatgaatcttacacaaatttgtgtgtgtgtgtgtgtgttagagagagtgtgtgtgtgatcctcaagaccactgagtcattctttaaaaatattttaaaatcataatttggtgaagaacttaacaacaaagtaactgaagccagatttgagagaagaagaatgaacagttcttcaggaagcaccaattcattccttaacattcaataagtctttattgcttcgcccttccctcctttttttcctctagtctaaactctgatttggagcagaagttaggaggaacacgtattctggtccctcttctctcatccctgtaaggaaaagcaatggtagactaatgacagaaaaagcaattgcaacaactttggcagttttgtggtactgggaaaaagcaggctttgtatttgtacatttcaaggaatttcttcaaattttagcttctttgaatgttcctacaacaagctgaaggggagataagatctgctagggaaatagatgaggtttagagagggaaaatggagggactactttttttttattcaaatagcattcaaacacatgagcaagatataacttgcaacattaaaaagtaaattagctagctaaaaataactcacaatacccttctcactaaaacaaaataaaataaagcaaaaactcacaaccaattattttgactggtaaaaacagacagtgatatgaaagtaacagatggaagcccagttttactcacacaacacactcactaaagacaattgcaagtgtccccatgacaataacttaacaatggtcactttagcctgagatatctcctttaggtgagtttccttaaagacttcagaggggcttgtagaaaatactgtagaacgaaaccaactcatttgtctatatgtagaaataggcaagagttgcaaatcacagcctgtggacgaaagggatccaggtgtcacatttgccaaatctttttgcaagactggaatagatattcttttcttatttattttttgttgtatggcagtatttttaggagtggtgacatttctgtacttttaaaaacacaacactacacagcacctaaaaactttcctaaatcaaataattaacagtaataaatcttcctgctaatttctcctcaaagttgaaagaaaggttattttcttacctcacactgagccttctgatatgacagtgtcattcagtcaataatttcaatgtcagttactgatttctaactcttttattacaaagacttcaagcaataatgaaatggtgctgatctgcttgctttcactctatataacgtctatatttatatgcttatgcttctatttggatctatatttatctgctttatctgcctacagtgcatctgtttctcatacacacagacatatatttatatatatacacacatactgtatatatatatataggttatatataaacacacatacccacaaaaatgtatgaatgtatgctagtgagcttacttcaacaaccatgcaggtgcataaatattcaggcacatgacaaatatacaaagaacataaatgaacatgtaaacatagttacacaggaaaaagaatatcttaacaacagccctgtctgccatacttggctgttggcctttgagacttatacactgttgaatgatatgtcatagactactctgagaagcagaaaaatcttctgaaggcaaaagtatatgactaaatcaagataatgaattctaactctctcattttcgcaatgaggagtctgagatactaaggtgaacagcaaagattttacagctttctggaggcagagctggaagttttacccaagtctctgcctgctagacaaatgctctttctactactatgctgaattgaaaggatgaaaacaattttttcaaacccaatatcattattttctaattgccactctttcccatttttcccttttcttgctgtgtgaaatgtaaacaaacaacattcactcagggtcaggcactgttctaaatattctatatgtactataccatttaatctgtaaaatatctctatatagtaggtattattattcaaaatcttagtttagtgaattaaataactcactcaaagctacacagctagtaaggaaaagggctgagctcccataatactcaagacccatgtttttctcacttaactatgatgccttccctaatacatatttgtatataatactaacccttccctcaccaccacagcctgatagtcttagaaatctaatatttgatctgtttcagaacacataacaagtttaaaggttctctcagcctgaggaaaaaaaataaagggaagtagagcaggtataagttacatccctagtatgcagcacatgccctatactagagaactgaaatatgcaaaattcccccccaaaattactccaatgatagtgtgatgtgatttaaagccttaataacttccagtctatgaacattttatgtcttttgcaaaggattatggcaaactgataatatagaatcagattggaaataagaccacaagaaggcaaagggaaaatagcaaaaggaagaaagacccacacccacttcttcttcctctcttggcacaacacttccaaaaacaaacacccattaaaaacaacaaacccagtatcaaaatttggtatttttttccccactcaagtgttagagacaaattcagaaaagaaactaagtctacgtatggtaggtagttttatacaaatctcttcagatagtaaccagttgtgagccatccgaacacggaggaattttacactttggccagctaacccagaacccagcactgggagatgtcatgtggatttgtgaaactccctggggcatactgcatccataagccaaagaacagaaattatactgatccatacatgcagctcttcatctgtgccatattgataattactcttcatttgtgaattaaatcctagttataaaaacaactttcagacatttgtcacaaatggcacattttacttaactctttcataacaccatctagccacggtctataggaaatgggagctaccatactcccatataggtcatgatattataggaagaatatgatgtagagaaagagagagagagagagagacagacttgagtttgaatcccaggttttccatttattaacaataaagctgtaggcacatcacttaaatgattctgaaacctcattttcatcacctgtggaataaagaataaaaccacctattttgcaggaacgttgtgaagattagagacatcccagcacaaagaccccctcataaaagggggcattaaatattaattattgtatatttaagaagtctatttgtgtgtgactttctcttgtattaatgatacataaatctgctgggagtaacagaagatgtgaggtactttttatgcttttttaatcaaagacaaactttttggtgatcacatgtgttccatgtaaaagtggaaataaaagcatatcacagtgtaacattttcagtggacgattttaaagcacttaataacccttgactttttgtgattgctggcactctcatttaacagttgggcaaaatggggttcagagatacatcctccaaatcagtaataataataaagaaatcaccagcaggggttagtagaaagtctgtttttaacatctaaatcccacagtgtccagctaaggaataactgctgcaaggtcacagatacaaaaggccacactttccccaaagctctttgagattattcactgaggccaaaacattaggtaatgctgtgtacatctgctgagataacaagggtgagtcagggttaggtcacggtttcaggttagaggggtggggtgaagagtggctttcagatcaaatgacgagagtagtttaatttaagcaaagaacaaaccatacagtattttaagtaagaggggaaaaaaagggggtgcaactacagccaagagaaggtgggtgggaatatagaccctgtgggggtcaaatgggtaactgtggctcaaagaggaaacccacccacattcacacacactgaaaagcgaacaaaaagcccagggtgcagcataaatcctgctatcccaataacacacacagatgttccaccattgttttcttttatgcacattttaattaagagatcagaatcaagcattaaaatgttattaaatggcttgtttacatttttgctatatgtcatttataatgcattttctaaatgtgtgtatatctattcggaaggactatttggaatttttacatcagtgctacaattgtcccactaactcacagtcatttttgctaaccaaatatgtgtcagaaatccttttcagtttaagcaactggacaggagctctcactctttaattctcagtcaagcaattccctacccccaatcacacctcctttaagcatgacaaagtccaccacagtacttcaagacaataggaaggcccaggtacactggcaacctttctgatttttcacaagagtcccagtttcaaatattctcccattgtgctcacaagaaaatagtcttcatatacatgcccgaccctttccctagaacagttttgaaaatgtcgggaactcaaagctaccacatgaaggaccctgacctatgagtgtcccctggaggggacacagtggaagaagcgggaactagtagatttttttttcctccccacaatccatcttctatttgcagtctacaacttatccctatttgcctgggcaggaatttgagttctctatattattctggagttaaaacaggtatgcctttcccgtctctcagattccacagatatcatgactgatgcacacaatccacctgcatatgtggatcacaagtatcctgtagtctgctggcaccatataacttaattacttttaaccacagggcattgtcctagaagcccactatttatattgtaccttatcaatcatggtacttggaattgcaaagtctcagaaagcaggaatcatatctcctccacgttcagttcaatgcctaatgcattgtgagtgttcagttaggacaagcaagagaggtaaggttttttctttctttttgttatttgtttgttatccaggataagcagaatgcttgtacagaacatgcataagaaagaaacgcaatctaatctcactgtcaatttatattctgtaaactgtctcatttgcagcataaatgactacaaaaatgttttggttactctaagtgttaaccttaaggtaagagttaaattaagtctgctataactggtggaccagaaaggactcagagaaaagcaacagcatggctttgaatcaaatcacttttggaagaaaactttaagatgttaccaccgaaaaaataaaactggcaaaatgctctggagggcatcttagcaatatgcatcaaaaatttaaaaaatatatgaagactgttgacccagaaatctcacctctaggaatgtatctaaaggaattactcaaagatctacacaaagatttagaagcaagaatgtttaccatggcattatttataattgtgaaagactggtaaccttgtctgacaatagagagttgattaaataaatgacagtacattcctagacttaaatactatgcagtttaagaaatcatattttagataccacttaattacatgaagaaatgtttttggaatactgttaagtgaaaaggcatataaccaacaatatatgtacaggaaaatatattgtttaagtaaatattgctaagttaaatattgttaacttaaatattgtttaagaagtgatagttgtgtacacacaaagtgcaaaaagaccagaaaacactagaagtgcttgtttctgggtagagaaattataaataatttttgtttatttgaacttttccataataaaagcacatttatttcatagtaaaatattacttaaaatattcatctataccaaccttccttctctaaaggcctaaaagtgaccctctgtaggcactcttttgtctctagaagtcttccttctcctgtttttatagatgtatgtgttgcattctaaaatcttaagtatttgggactatgtagttataaaagataccctaccaattaaacaaataaaaaatcttattaaatctgtggttttaatcttaggttcctgcttagaaaaaataccaatttctctttaagtcctatattttgctttcaattcagcctccatagtattaattagttatattatttaggcctgcagcagaacagtttcatagttcttctcattctcacagttctttgtaagagacaccacccctctcatggttcttactcacccctacacccacaattgaccataggtaattgtgcaagagaccacaaatagaaagaaaatgaaggaagccttaaaaggccaaggtagttccaagttataaaacagagaaaggctgaaaatttaggcagagatgtggagaaaatccgagccatgacacttaagaatgaactggagtaaagatccatgagcacctggtgcagggagagacaactctacctatcaatccagtacatgctactcacacaggactattaattctagtaaataaccacagctttaggaggggcaaatgttctggaataggctgcctgttgaaaatacaagtgctagggcctttccataacctataatcaggacttccagaagtaatatccaggcatcttcattgaaagctccaaatgtgattctgaattatactagaggtgagaaccaatgggctactggggaagttcaaatcccttagctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagttaaagttcactttcatctcaagagaaaaaacagtcattcctgacttacaaacatgagtggagggaagtacctgaacacagggattgctttcctcacatctggctctaagatacaaccacgcgctgtgacatataaaaaggtcactgacacgagaaaatatcgcaagatattacaaggataatcaaagccaaaatatatccaaacccacttttggagagaatcccaataacttcttttgaatgtgataataaaaataacatgaataaagatcattttcttaagaaaaaaaaggaacgtttctatcacttgcctgccacttgccacttaggagtagactctggctcccttttccgcttaaattcttccacagagtcagcttgccagactcttaaccaaggtttttcttttatctagactataacaaatactccattttgggtcatgagaacatagtagcaaaattcccagagttaatactttaattatacacatatgtatttattattttgtatgtgtgtgagctgttccactaagttaaactttaaccatattaatccaggaaaaaaatccctgattatcaactaacaattttgtaaacagttatctcacaggttaaatattaactcgaaaaatttaactcaaaactccacacaagcagaaggagccaaaaggccaggaagaagaagtaaagattagctgctttaggaggaacacagccaggaaagtgagcattttggtagctggataatgtgtaggaagtccagggggttgtgcaggggggggaaatagaagcaagaagggagcctggaggacacctgctgcttatcataatatcaaaacataaaacaatgaggtgagaccttaaggaaaagaaaattcatggagatatgaatccattgataatggccacaggaattcaggtgcaataaaggtttgaacctcaatgatatggacatagctaaaagatccaacacaaagctagctggagcggactgcctgcctgccactgaatatcatgaggaacattctggggtccctcttccactagaaataatgggatgaaggctgctctgcctgtcctgtttctgtttcctaacaataaaacaaaactgaagtgtctccctccagtattgggttattaggggcaccgattgcaagttctaagcctttatctaactgtccatcaattctctccctgattaacagaaccatatcacgtaagaaaaagttggaaccagcagtagactaagtcagaaggcttttctgtaccggaattgctgaactacaaatattgttctctggttaggattttgactaaaaaatgtcaagaaaatccacatggccagagaattcgcacaatcttgatatctgaggtacagggtaaagctgatgtattttaatgctgttttaggaaggttagaaactgttaagattcttcctgtcagtatgtcaaatatcagatcagtcctgcttgctgatttttaaggaagtcattaaaaaaatcctcccagtgagtagctttcaaggaagactcccatttgcccggcagatctaaagaaataatgaggccaaataatgcaagtttctcaagagaggtgtaggattgaatgaaaaaagggaagatatagaaatgtaggagaaataattcttacatatataatatatataatgtatatatgtatatattgtgtataatatgtatatattgtttatattcaagaaatatgatatagcttatcatatattacttttgatatttttcttatacatctagtacatgaatacatgcttattggaaaagtacaagtacaaggtgtagtctctattatctaaatatattatttaaatatatatctaaatatattatctaaatatagatgacacctcgtacttgtaaagctttttgcagtttataaaatatttttgcataaaatatcttttgctttcctgacaaccacaaaaagtaaaaagggtgggttctataatttctgttctatagacatgcaagtattactctaccattgacgtaactggtgcagaataaacctgaacagaggaaatagaatccattagtagcctggttatccatatccacatgccaagtaagaaagcagcatgatgactgtggaaatgtaaaggcattataagagtgatttttggagaggattaaggagggagacatcaaaataattcaaaaggaagtttagaaaatcagtagaaataaagggctaaatttggagtaacttttttggaaaaaaagtgtttagaacaaggaaagaaacttccaattcagaccatgtattcatttggcatatactaattgtatatctatgtttgattttctttgatagatgctattgggtaaataatgatgtgtatggagacactgacctgtgcctgacatatttaatatctatttgttgggataatgcccagaaggaattattatgcaataaaattcagatattcagaataggggtttagagagaaaatcatcactgatatgtaggctgacaaaggaaagcttcagtatgatgaacaaatctagttatactttgaaaaacatgtaagatttgggaggtgataagacatttcaagttgtgtgaagggcatgagagaaagcatggaagcagaaaattgagatatgtatttgggagcagcaaataaacaagttagttggaattgtaataggaaacaatgctggaaagatgggttgagtgtggaatgcgaaacggggtccttgaataatgggctgagtagtccactttattctgtgaacacaagaggtctattaaaggcttgtaaagtaggacactggcatggtcacagtgatattctagtataaataattgggaatggtggacagaaaaaactgaaacagggagagcataaaggtaatgagagagaaagagagagagtgcgagcttgtgagagcaagagaatgagaagtgatccactgcaacaacccaggtactatgtgataaatatctgacttcggtagtgtcagcagaaatgtacaggaaataacatgttctagagacattgtggaggaaaaaataacaatatttactaaagttctactctgtgccaggcaccgaactatgtgctttatgtagattaacccattaatctccatgctaaccctaagaggtaagtaactttattgtttccattttacagataaggattaagcaactttttcaaggttatgcagttagtaagtggtgaagcctggattcaaacccaggcaatctgactccagagcctgttctcctaacccccacacttactgtttttcctaggtacaagggatcttttggtggattatatatgacaagatttgatataatttgatgactgactacatatgagcaataaattcgtgggattcttgggattctcaattctgagatttttgggttatattatgaataaaaagaaggaaataaagaagatcttcttgacttcacattgtacatttgttcctaatggtccaattgctttttggacttaaagtatcaatttacaataaaagccacagaagcaactgaaccaccaaaccggaaagctctttgaaaatgattcttctttctagtttcactaatgtatatctggagtatagcacagttcttcgcatataggggatgcccaacaataacatgatgaatgagtcaactggagaagtattaattgtaataagtgagaataagggagtggagggtgtaaaagtcaaaagagtatgacccagagtcagacaaatattggttcatatcctggctcagggccctttctaactacatgacatacagaaagttactttaaacattttgtgtaatatggggtaataattcataggaaagctagctaccttactggattcagtggttttatataaaggcaatgggtgtatgcaaacctagtaaggaatgctcccaaaggctgttacctctgacagaagaaaatctgcaacccctttctctttgtttaacttacaaaaccacatgaagacctaagaaaaaaaatctgccaaataaattccagttacaaaaggaaaataaattattttgaaagtaaaaactataatttcaactgaagaagagattttaattgcagggagatagatcagttgaatggtttaacttggacttgagaaatcagtagcagccagtgggatacatattaaagaaaaaaacaagtttaattacccttaagattttatacagcttggctcttccctcccacacctagtctgcttccatcaggtcagactccttttcaatcacactctcttccatccttttctcagttgctgtcatgacaagccaatgagagaatgacataccgatgaaaacaaggtttgagtaattactgcactgtggctggttgttgtctgggcatcattttatttcttccaatcaaacaggtccttggacttcacagctctgtttcaggtgggggtgatgctgattatattatgacattatagcaaagacaggcagatcagatgaagtgaatttcactcagtaattaaactgcagtttctttcgtctaaagtccagggcaggattaatcgaaacgtagctctttatcattcctattaatgctgggatttgaagagtgagctctgatttgatagctagccctgaatctggctgactggtgtccccaaatctgtctaacttgcaaaaataatatcagatcaagatacatttgcaaggttatacccttcccttttattttacttttttttttgataaggaaatgcaaatagattcaaatatgctgccatttccactaccttgttttctattacaaaaatgtctgtgaaaaaaatcaggtccttccaaaccccacagcattttacaaatggttttccataattccacttaacaccatgctctaatggcttctaattttgtgacttttcattatctgagactcaatatgaatatttggatggcccaagcgacagcttttcagaggctcaaaggttctacttttattttaaaggactcattctgggacttatatagagattttgtttcattcaatcactcttgtaatgcatatgatatcaccaaattctttaacaagtatgagttggatcactgattctcaatcctgggtgtccatagaaggacctgtgaagctctgtaaaaaatcagcctccagcctccactccaggccacactcacagatcggaatctctaggttttagacacaagattttatatattcttgaactccataagtgatttgaatgtgcagctagagttgaggaccagagtcagccacacagtgtattagctgtatttgcaaaatatttattaaaacaagccattgttcagagaaattagcctcacattattgtgagagatctctcaataaaataataaaaagcttattccagtagcctttgcatagaaaaagatatacttgggtttctttccttcttttcttttttttttcttagacggagtctcactcttttgcccaggcaggactgcagtggcgctatcttggctcactacaagctccgcctcccgggttcacgccattctccttcctcagcctcccgagtagctgggactacaggcgcccaccaccgagcccggctaatttttttttttgtatttttagtagagacggggtttcaccgtgttagccaggatggtctcgatctcctgacctcatgatccgcccacctcggcctcccaaagtgctgggattacaggtgtgagccaccgctcggcctcccaaagatatacttgggtttcttaagggaagtagaggaaaaggaagactgtaaaaacagacaggtaactgttgatggggcttccattgttctctctgataacattgaaggtgatggtttactgattgagctcatcacatggtaacactatagctaccaaccatataatttaagatgacagttgactaacatcatagaatctcagagtttggacataaacttggaattagctgtcatctattttaaccccttctctattcagctgcctttttagaaagagaggcagaatttagaagactttatttcaaattctgttttcagttctgtttcagagtttaagaatacacgttctagggtcaaactgaattcaactactagttgggtggcctagatatttacttctctaagccttaattatcccttctttaaaatgcggcccagaatatgtatctcaaagagctatttaggttttatattaattaatttagataattaactagaatgcctggcacacaaaagtatcagaactcaataaattaagtctattgaaggaaattgcaatagtcacttttaaggttgtcactgagactctatgcttaacaactatcagtttggtgactcacagatcagttttctggaagatttgatttgccaaagaaaaagagagtgagtccaaataggaatggctttcacatttaattgagccataaaataaaatacattttattaaataaattttataaaatacaattttattttaatgatcacctggaaatgatcattaaaaatgcaaatttctgggctccaatcccagagattctgattcagtttgtaggagtggagtctaggaaccatccaggtgattctgactcagggtcaagggtcttcactttaataaagacagttataaaggaatataaattagccaagcatttatcccccaaataactacagtgtggcttgacctggaagagaccatgctttctattccttaagtcagaattcagttagatgagtttaaaccatgtgcaaatacaaaatgtttatagagtatatttatgcacacagagttaaaaaatctatttctcttcaattaaatatgccttctcaacaattatcatttagccactaacattatcttcatctcttttcatcactactgggtacatgtaagtatacagacaagggtcagatttgctatcgactcatccattttcttcttacaaaataataaacaggtttcataaaattggtaaattccttgaataaacaaaagcagctatttcctcctctaaatgcattgtagaataaagtattttcaaaacgcattaatcgaaattgataatgaaagtcaatatataattgtgagttgaatattttaaatgcaattgattacttcgctaaaatgaatatactcaacttacacatggagactgttctggatctaaggagaaatttaaacattttcattcccaatcagcgaaatcccagaaatgtgtttagagtttctaatacaatataccaacaaatgtgcattaactctctatattctaaaagttattgtgtaacaaataacaggagaattatggtctctaattgcagttgaacataaaattgagctggggagaaaataaggcatcaacatgagaaaagtttttcagcattatacaacaatataggctagtggccaagtgtaaggctgaaggagaatctttttagtacatactgtgtgaggcagggtaagctaccgaagatctgcaaaagtcaggcacagtaactcactgagggggttgtggtgaccacagtgggtactgaataaatgtaacctattatttattataatagttgacagtttattttagtaacacaagatatatcacagataagactatgtaaccggtaaaaggtgaatggtacaggcactgagagttacagggagccaaaactgagagaatgctggcatgactggtaagggttttgtgaggaagagacatttgaatggataatgcaggagagagaggatttggctagacagaggaacaaagatcattttagacagggtggggtgttttgatatgaatcgcaggtcaaagttaaaaagtgtttaacgactgttaaaaaaaacagtttaggatgaagccataaagataaatttgaagtagaacaacagagggttctggattccaaaaatcacttgtagtttctggtagaatttttaattgtcaaaatattttctcagtggaattcaatatctctttagatcagtggttctcaaattttagtatgcatcagaattacctgaagtgcttgttcaaatacaaattgctgtgttccacctcaaagtttcttattcagtaggggaaagtgaggcctaagaatctgcatttctaacatattcctaggtaatgctaatgctgctggtcacttggagaaccactgctttagaagacagtgagataggccgggcgcggtggctcatgcctgtaatcccagcactttgggaggccaaggtgggcggatcacgaggtcaggaaatcatgatcatcctggctaacatggtgaaaccccgtctctactaaaaatacaaaaatttagccaggcatggtggcaggcacctgtagtccccgctgctcaggaggctgaggcaggataattgcttgaacctgggaggcagaggttatagtgagccgagattgtgccactgcactccagcctgggcaagagagagagactccatcacaaaaaaaaaaaaaaaaaaaaaaaaaaaagtcagtgagataagagaagagttggatgaagagtttcatggataagaaagagttggacgactatttcctaaagtcaccatataatggaatagccctctttatttcctataaaatttcaccctccctttcataccaacacatagagaaacctacatgaagattacctagggatcaaaattcttctttggctttctaatccctctattgggttcaggtccttaactgtgggaatgaagaggcccatgatcaaaaggagcccaggcccaccaacctggaaacttgaagacaacttaatcactattaaggatattcaagaattcaaaataacagacccaagagactaaagaaagaaggtggaatttttattccaaaaagcctctgtcagtttcatgttgaacattttgtacttgggctgcacttaactgcctgccccttaatccacaaactaatatcatctcaccttggttcacctttttcttttcttcaaaaggcagtcagaagcaagcaggggcaatgagaactttctacctaggcatgggccactgtttaagcatctccaccttctgcttcaaaatctttctccaaaacaaacttccactatgtggtaactatactgtaagaaatcatttaaaaggcagaaagaggaaatgaaatgctctgagagactattttctcatgcataacttcgagggcagtatctcacaagtcagtactttatttttgatggcagacaaaaaacatgttgtgtttgaagattcatgtagaaatctttgtgaaaaaaggtcaaaattggatttaaaatgttcaaaactccaaaaatctctaaagaacaggagcttgtttattttctagcaatttatctttccttaaaataagaagctatataattacaaagtataattaataataataacaataattaccacaaatacaacagaaataatgatagtaagcaccatgggcccagatccccatagttacaaaggataagaatttgtctcagtatatttgagaacagacagcagcccaataatacaggaaaaaaaaattggaaaggaaataatctttcttgtgctccctggaaaataccacagaaaaatagacaatcaaatttaatacctgttgttaaatatcttcattgtacagattaggtcaggcaatttaaatagacaacaacatgaggcctctaatgtctcttaggaaacagtttcaatgtaaattcctaggaggtcccaattcaatttctagttaagcatccccatccactcgtaacactcataagaaggagaaatgcatttgtatggtgttttacagtttataaattattctcacaaacgtgttatttgattgtctcaaaaatcctgtggggtaggtaagtagagaaagtattaatagtatacccattagaaggtgaaagaattaaggatcagagaaaaaggacataaattaatctttattaaatatccacattgggtcaaactgtgcagacctggaaagaagtccaaataaagttttacataacatggataggcttggagaatttgttaactgcccaaagtaaaaaaatggaagagctagaacttgaatgcagataatgcagctcaagatgtaatggtctttccatcagaccatagactaaactctcagttgtaaccatcgtctagttacagtaactgcccctctcaagaggaggctatttcattgccaagaaataaaaccgtgaatagtggtcaggttttctgtttttagttagactgaaagaaagcacatactccttgagaagacgtgcatctttttaacatgacttagtctgtcaagagaataagagagagaatgtgttatttcattcatgtagaatactgacttttaaaagtcactcaatttctctaatgatcagtgatgttgagctttttctcttaggtttgttggctgcatgtatgtcttcttttgagaagtgtcttttcatgtcctcaggggagggcagtgtgggggcagagagaatcaagaaaaatagataatgcatgcggagcttaatacctaggtgacaggttgataggtgcagcaaaccaccatggcacatgtttacctctgtaacaaacctgcacatcctgcacatgtgcccaagaacttaaaattaaaaaaataaaaaataaaaaaactgactccagctacccatggacacaagagacaacacggtcccatttgtcaccaaaatagacaacacagtcccatttttcactaacatactctttgcaagaaagataaactaaaagactatccaacattaatagctagattctggcatagtctcagcttaaactattagtttctaaataagaggcaatacatatgcatagtaaaatagagaataacagcaatggatgtattaacaaaatgcattttccattaattgttatgaattaaaaagtctcgaagctatagatcgagactttgaaacttctggaacaaattaacctatctctttttatttttactttatgcatgcatttacttgtgtagttggtgttgctatgttttcttaaatttgtttttaagataattatattctccctctacttttatacatatatcttctgaggcatttaaaggtttgacaaagcagtgtcttctcacaagagacagaggtttcacttagaagccatcttgggaatttgggctgcagaaatcaagggaggtctagtacgtaagtaaatattagtgcaataatattaaatttttgaatactaaaggaaaacatttattgaaagaaaattgctttatatccttaacaactaccttgctatcgaggatttttagagaattgcagaatttcagagttgatgctatatgtaggattttcttttcttttaattttttttttagagacagggtttcactctgtcacccaagctggagtgcggtggcatgaccatagctcactacagcctcaaactcctgggctcaaacaatcctcccatcttagcctcatgagtagctgggatcacacatccggctaattttttttttttttttttttttgtatagacagggttttgcttgggggcccaagcttgtctcaaactcctgtcttcaagtgatcctccctccttggcctcccaaggtgctgggattacaggtgtgagctactgtgtctggccccaaagattttatttttataatgacagaatatcagtgttagcagagtccattaaaattatatatgacaatcatctgtttaacccatttatgccaaatgttgcaattttgtgtgtgtgtgtgtgtgtatgtgtgaaaaatcagaacttggtgatgaccttgagcaacaggatatacataactgccacaagcttagcattccaatagtggaacactaggcataaatgggttatggcttcagtatcctgcaaaatatccctgtaaggtagctgtctatgcttaaacaccttggtcttaggaaactaggatttgtggatattaggcaatgttatgggctgattgtgtcccctaaaatacatagggtgaagccctaagctcctaccaactgtatttggagataaggcctttgaagaagtaattaaggtttaatgaggtcataaggttggcactctaatccactaggactggcgtccttataaggacaggaagagacatcagaggttctcttgagctcacaaagaaaaggctgtgtaaggacacagcagcagaaggctatctgcagccaaagacagaggcctcaggaaaaaccaaacctgatgacacctcagtattggacttctagcctccagagttgtgagaaaccaatttctgtttgctagtccacccaccttgtggtattttgttatggtaggcctacagactgatatggtgcctgtatcagtgcctatatggtgcctatctcatcacaacctgtaaggaaggaattacttaaagccaatttataggtatagaaacagactatggaacattcaagaaatgtcccaagagacaaggattcaataagtggcataactgagatttaatctaggtctatcttccatattattttttaccctcctattttttacctttgaacacagaaggctgctacaaagttagtgtttcatattgacttgagtattttattcttgtaggtttcatcactggctgatggtctatttgttggagtaacagaaagcaacataatttatcttttagatgactgtcattcatatacttgaagatagttattacattccttcctcctgaatttcctgttaatcccggttcccttaaccattgctcatatcacatgtttcagttccctaccattctggccacttatacctgaagatgttcctatctatttaaatttcttgtactgggttggaaagtcatatctctgctacgtcattcatgactagtctttttaaaatataaaggcaatatcttgcatttatccatttagaaaatttcatctgttagatgtagcccataattccagtctttcaatgtctttggaattcgattacttcattcaacaacttttctatgtatctggactcatgtcatctgcaaatctaatgaatatgttttcattccagttattgaaaaaaacttgtgaccaagataaggccgaaaatatccttgcaatatgccacaggaatcccctatattatgatattgagccatttgtttgtacctaatagtgtggtcaatcaaccagttactaatccagctgtacctacattagttactaatccagctgtacctagattagtaactaacccggctgtacctagattagtaactaacccggctgtacctagattagtaactaacccggctgtacctagattagtaactaatccggctgtgcctagattagtaactaatccggctgtgcctagattagtaactaatccggctgtgcctagtttagtaactaatccggctgtgcctagattagtaactaatccggctgtgcctagattagttactaatccggctgtgcctagattagttactaatctggctgtgcctagattagttactaatctgtctatatatctaacccaggagatatcagatcacatattgtagacatcattttactgaagccattctattgtctagcaagcaccacttctttcagtggatcatgatacattgttttatactttattgctttaataatccattctagactgttgctcaggactaacagcaagtagttgcatcatcataaattgcctttctatactttctgtaaatcagaagatttccacatctctagttatctaacattgtttctcttctcctcaaacatggatggtagtaattgactatctcattgacaaatcctctcatgagtatatggttctctatccctatttttaggctcttctccttttcctttttttcctgttatcttccaaggaaagagtcactcatgtttaatcatgaacggtatgttggtcagagatagacctgcaaactggaacaactgagaagatttatacaaagtgttgtcctagagtccctgactgtgcccgtagaggaaaatgtactatgattaggtgaggctttgctctcatctccacacagggctctgcatggcttttctatttcacttctggcagtactcctggggaaggctacatccttttcctattcattctgggtgacttcctttgccaaagattcaagacagctttgtatttttcagtctttaactgagaaaggttgtgatatataatgcctttattttcccatgaagactttctctgaggcatgcacatagccacgacctttacctaatcaagaaaagttgcttgggcagtgggggatggggatgcaggttggactttaaatgcacaaatcagttctaataaaaacactgagattcaggtgcctgaggttagaaatactggagggaattcaattacactaattaatatttaagaagggctagagatcacacactgaatgtgggaaactaggccagtcagacatgagcatatggggagggcaagatcaacagataaaagtaacaaacaaatcatacataaatgctccaacaggaatgaaatagagaatataaaataaatgttccaacagacactgaagaggaggtaaatggtctaccagacataaaagcaaaatgttccaacatacacaagacattttattggtttaatgtaaacacatatattataaaaatgatttttccacataagttagtaggaaatgttacccatttatagaaacagacttacgggttctatgaattcacagcatactatatttgctctcatttcctcactggctcatcatgcaggagtctcaataaggcttgactttcataacaggtagttctccaatgcctaagcctacctggatacccaacgcctgacagaaggctgaaaagctgcagagtgtgcctgcttctgcacaagtttttctagttccggttgctctaatgtgatttggttggtgtcacagctaataccacattctctatttgatctgatttttcatctgtggcccagacagttgattctgatttttggtcattcttttatagacttgaaagttttctagagaaggcactagtggtgccaggactatcttgcttccttctgtcctgtctacactagcatttaattacacttttctacctcttttctacctctatgccctctcaccctccttcatcttgggagcttccaaaactagaagccaagagaattaactaggttgctttataaaaattgtatatatgtagggtaaacatgacattttgatatacattggattgcttttgctatcaacggcatcatgtagaggtagtagtagaagcatggaagggtagaagaaaggactgagactgatatttggactcctctttcaagttttctgatgtacacatagagtaactagatggcctggactgtctatgtacaatacggaattttaggctcctggaggaaacaaaccaaaacaaaaataaaaacaaagtccttttccttcagtagctttagctttagaagaataaatgattcacatataccaaaacccacaagatacggtatccccaaaaagttaaattgtctcttacctaatagaggatcagaaaaagaaaagatagttatttcctaaaaattgtttgaaccaaatttgtggttttcaaactatgcttcatggtccccagacttacaaagagatgattacaaaaagattatcaaatagatataaataaataaaaaaataaatacatatataatatgtagtaaatacatatatatcaatttgcaattgtgataaaaatgacatgcaaatttaaatgtattatataaatttaaaaaacactggagaccaatgtgttattacaagttaattatgtacaataagaataagcagctttcatgcaggcctctaattaaggctctcagattggaatacaagctgttgaaaaaaactgttacaatatgcaactacttatcagtctcatgatttttttgataccatatagtatagtacagaaagtcttcacttattgccatccataggttcttggaaactgtgattttaagtgaaacaacatataatgaaagcaattttaccatagactaattgatataaataagagttaagttcttatggcaaattttgggtcacagaaacatcatcaagtttctaaataaagatcaaaacacttttgatattaaacattgaaataaatgtgagctgtacatgcatttaagaaagattaataaaagcaagaaataaatgtgagctgtacatacatttaagaaagattaataaaagtaagataattatttaatcaataattccagttcagggtcatgagtggatggagcctatctcagcagctcagggactggtaaggtgggaaccaagcctagacaggatgccattctatcttagggggcactcacacacagccacattcactcagacacacccatgagcctaacacgcacatctttgggatgtgggagaaaacccactacccagagaaaacttatgcagatatggggagaaagtgccaactctacacacacagtggctcactgggaatagttcttttttttttttcccatcagcgttatgacaccatgttatttgagtatctgctatattccccatacaaaaatacattgatttttgagccaatacaataatccaatgctgagtttttattcctttgtatatttgccattatattcttattgaatgactttataatattcaatatgataaataatctgaatttgaaaatgagtttatctcaataaaatattactcattattccatatgttaagtttctaataagatttagtttgaaaagaggattctgcttgtttaaaagaaatatgaaaaatgtctggatcaaataatatatatgtatcctgcaactcaaggcagtatgaatctcatatggctccaggctgctcagtttctgaatttatcaacttgctggcttagaccactgtatacagcagatgcattgggcccaaactagattttatatatgggccactattccttcaggcttaagaacagtatttttatactgaggaatagcttatttatcatgaaaccatcatacatcaaaagaagtcacgttgccttaaacttatccagtacatgaaatttatcaccctcaaagttctagattatcagaatttaatatattagtttaaaatataaccagttgataaccaagaaataagtcaatggaaacctctttaattatctaagcagctcatcttgtttataataattgtataacttacagatacatactcatttatttttcaatcaaaatatattatattgaaagacttcagaagatttttttcttaatattaaccaacattacttatagttaggaacagagtgagccaaaaaggattctcaccactacagagaataaaactagcaaacctggggaaagatccattttccaaaacctgaactacactctatgatggtaacgtttcaagtatttataacacttaagtataagtcaagagttgattgaatgaggcctttcatgatgtttatgtagagtagtcaaaccagaattatttatgtatttgtttatttttaaaggctgtcatttgaaagttatcacagtataaaggtaaaggatacaccggagtttccattctagctccacattcctggctgtgtgaccttggataatttagttaaactaaacttcagttttcacttctgtaaaatgaaggaaatagtagaggttctattgtcatgaatttctagcaagaaatcaatgaataaatgaaatgatgaatgaatgttgcttagcatgttgcctggcacataaaaagctctcagtaaatattaactgtaattaaaaaatatctaaaagccggttgctttcttttggttatttttttaatatgacttgattttattcataacttactgactatattttcttcccttctggaatgatgttctattgaggtttctttttcttttattccagaatgttctctgagcaatctcttcatttctgcctcattcatcagataggattgtaggcgttcattttggtagttctgcatttggttttctgtcactgcttatgctgttttcttgttctaactcagtggtttaaaaagtaaaattcaagtaaggactaaacataagagaatttactgggactaatggttatcaaaattgggcataaagggatgttattaaaaataaatcacacagagggagaacagctgatgacagcagctgtgaaatggatgtacatggtgggaatcagtgagccccaaagaaacaaacaaaaaacactggagggccatgaaacttacatgatttacaagggaaacccaagctttatgaacagcctctgaagactacagaggccaagcaagtcacttctggatgaaaatttggataagacagcaatactgaaaggagttatgttccctgatcaaatgggagctacagataagaaaagaatgagaaataaaatgaaaatctttaccgagtttgatttctttattgtataacctgcactgaggggacaccatctctgggtataccactatagatacacttaccaaatgcttagtgattattgcaatagttagaagagaatatattttaagagccaaagttacaaatctatggacaagatgaattaatattagaacccatgttgagatatatagggcccaagtagtctatgacacaaaagtttgtgtttttatttaaatagaactctaaagacttagttgtttgaaatatatttaatgtagagaaacatttttttgaaaatttggtttactgtaaagatgaatggagatgtctaactttttgccttttttttctagatatggacccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttcaaatctctatgtaggaaaaatatcccacattcattcccattttactatgaactgtataaacttccaaaatcatcatgaaaagaaaaacatcaccctttctgctaattaagtgttcttgctttttttctagtaatgggtatttgaaaaataacaatatgcaagagtatgatcttacagtgaatatagccactaggtcaatatgataatttaatgtgagactttaaaattgagctttccttttatgctactattctctaaataacttctttatttgctatgattaaaatatcttttcatcaaatttgatataaatatactagatatggtaaatatatttatcatttaaaataacaattgaattgtacaataagcactatatcattgcccaatttttattttgataaaatctttttaagtgatatcatttcatgttaggctttttgtgctgcttaatattataattaataattcatatttttgtctttctcctctctgacaacttttatttttaatcggtgggcatgtgccaaattggtttgttatttatttataatgtaaaatgacaagggaattgaatatgtgaaataagatagattttctttcatatgacaaaaatttcttagtaatggggatgcttcttgcttacccttatagattcaagggttttagagaggttaggtcaaatgtcacacttctcatataacaacatgtggtaagtgcattaaatagactgttcattttttaaaaattcattttagttttgtgaagacatctgggcacatgcataaaaaacaggacaaaacaatatcaaaatttgtaaaagactccctattccgataaatcctatagtgtcaattaagtaaaaattctgaccaaacagatgtatttgtattctttcctaaaaactaaaacaggcaaacgtaataggaataaacagagaacgtttcaaagatacagaatttccattgaaaaaatcaaatgttctgtctgtaggactttatagaacattaaataatcttttcagtactgtccataaccagaaaccacataagctggatgctagactattgactagttatgacaaaaaattcacagtttgatctcaagggcatcagcgatcctgggctcaggtgatcctcccgccttggcctcccaaagtgttgggattacaggtgtgagccatcatgcctggccatcgtgccaacgtattgaagtggaaagaactaatgctgagcagagaatgggccatacctgggtggttttaagaggtgctgctataatgaaaaatcacaggctcacccaagaactaccgtggaatcagaacctctagggatatggccctagaatctgaattttaagccagttcctgaggtgcaattcagtttgagaactacagtcttaaggcaaaacctttctatcataccagagcttccaattgtcaggccctttgaatccaccctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaaaacaattttagatcttaattattttgttattaaaatgttgggggtgtttaagttgacattgagtcagatgtaggaactgatatacagtgaagttaaatcctttagggtaaactcattcagtggtagaggctgaactacagagcctaggcattctgacattccaccactgtgcttatcagcttgctccttgagcaaaccttttcctgcctttatgagaatatgcccattttatgggctctgtatctatgagatattttacctatgcttatgtacacatggtgtttatctttcaaagctggactatggaaaagcctaattttacaaacatgttagtaaaagattatgtaatctgaggtgattacgtttaaaatggcaatgataatgatgttaattccagtcctgtgaggtactgtttctgatctggaaagagcagttttcttttttaacagcttattttgtattttcataatccattttaaggtttggtattaatatagacatgagaaataaaatataactgttgccatgccaaatgtatatcaaaaagttgctaatagccatgactgctatttggttaactgtatttcactatttaaataaaatgatggaaaatggtgtgtctaggatctcattcataataatgaaagacaatagaaactattagcataggtatgatgctaatgaatggtaaattttcaatagagatccatcgaccagattgtttgaaaaatgtttcctgtgggtacgaaaaatgcacacaaacaaacacatgcatcaaaatgtccataattaagtttttagggaaaaataacaatatatgttggttaaggactttcacttaaatggcattatagatctttcagaaatgagagttgatttatacttcagtattttggttcccaaaggttgggacagtgggtggtagaggagaagtagagtaaatggaaggtatacatgtatgtgtgtgcatatgggcaactttaagcaccttgaatttaatgaacaaaaaatgtcattattctgtgtttatatatttttgtgtgaaacaagtacctttctctatcactggagtttacatggattttctcatgatatcttttgagaatctctttaaacactaaaatacatttttccaaatgaaaactcccataattctgctttattaatatctgaatgaatatttccattgatttgtccagaagaaggaactgagtactgtttagagagcaatctttttcatgataattggcagcaatgtttccctgctatcagaaagaaaactatagaaatacgaaactttagataaacatggagataaaaataatattatggagtccaactggtatctttgaggtgaggacaggctgagatggactccttggcttccttctgtccaaaaatttcctgtttccctatttcctacggttaccaccatggaacatgttaaaatctcagtagggactctgtttcaacttttcctgtcaaaacacagtgaaaaagcttaatggaaaaaaatgtccttcctatctccatgccaggcacagtgtaagatccacaaacttaaaagccaggaaaatattcttttatgtgccccaaagctgggcaagtgacctagtactacaaaaattcccaaataggcatgtgacctgactaatgtgtgctgtgagatgagtcaagaaaaatggaaccatctgtacttttattggacagtcaaataatttctttctgtccacccaaaaacataatttctatgttaagagtgatacaaggagacttttagaaagtctaatttttaaaatcagagatattaaaatatatgaaaagtataacctattaaacactggtggagataagcaaataggcttatgaaatcattattgctttaaaaatttgttacctactcattgtgtactaaggcttctctacgacatacagaagaggccggtgcggtggctcacgcctgtaatcccagcatttcgagaggctgaggcaggtggatcatgaggtcaggagttcaagaccagcctggccaagatggggaaaccccgtctctactgaaaatacaaaaaaaaaaaaaattagctgggcatggtggtgggcacctgtaatcccagctactctggaggctgaggcagagaactgcttgaaccttggaggcggaggttgcagcaagccaagattgccccactgcactccagcctgggtgacagagcaagactgtaaaaaaaaaaaaaaagaaaagaaaaaaagacatacagaaggaaatcagggaaaatgggaaaatgaagggaattaacaaattgcaataatctttaagaagtagagtatgaacaattttccttttctaggatgaaagctaccaacaactgaactcttagagtgagtgatggcagaaaaaaatagcaatcaagaataggggcatgttagtttttagacatgtttacaaaactctgccttttatttcttaaacccataggtcaaccacccatcatacctacattaccccatatgacaagtggatttgttgtatgtttcaagtttttaatcttggtgggaagggggagggcagagaagtatttattggtaaaatatcataataaaggttgagcctgtcaatgattgtacctaacaataataaatatgtgtaggaagtaagaacggcaaaaatgaagccgggtaggatactgtggatatggtgacagacaagtatctatacgaaatcctgagatatttgtcctccatttcataaattaaagtgccccctcttttgctttacagataaggaaactgaggtgcattataatagcaacagcagctgatgtgtagtagatccataccacaagccaggtacgatgtcaaacatttaaatgtatcatttaatttaattttcatagatctcctacaagacaagtgctattattttcattttacatacgagaaaactaaagctgacagagattaaataacttgtccaaggttgcatagtaactaagtgaaagagccaagatatgaactcagatctgtctgatttcaaaacccaggcccttaaacactaggccagtggttttttaaccctgattgcacattagaagcacctggcaagcttttaaaacctactgatactcagaccctaccccagaacaattaaatcagaatttcttgtacctgggccctgatgtgggtgtttgtttcaaagcctttctgggtgactgtaacatatagcttgggtaaagaagaattgttgggtgtctcccatggaggtcagtatatctgtgccaatatgtgaggtagtacaagactcaagtgtcctcagtctgtctgcagtggtttttcccttgccccatcatgttcactttgacatcttttttttattatgatttttggagaagtaatatacaagtgacaatttttttacaaagcattgtcacagcagaacatggtcataagtccatcaaagagaaacctgttcatatctatgtacaggctatgatgaatgaatacaaagaagactatgtttattactctcatccccaaagggaagtataaagctggccttaaaagctgttcataccaaagctaatcactaaaatttggaatggcttcctcctctcctttcacaaatgcaatagggtagccactggatctaaggggaaaagatccaattaccactctttacaatgctttttcacttaggatctcaagacgactgacagtcattcaaaacataaaagtaaagtgaaaatatctctagtagaagtgaaaagaaaatgtctgtagtaggaagaaggcctaaatttgtgtctatactctgccactttactgcaatgacttgaggccaaaagtaaagtgacagagtatagacacaaatttactgccatgacttgagccttgatttccttttctatatgtacttaagccatatcatccttagggcagtgatccaaaaaatgtggtccccatcagcatcatgtggaaacatatcagaagtgaaattatcagtccctaccctagactctgaatcagaaacttggtgaaggggcagtaatctgtgtcttaccaaacattgcaaataattctgaccacctccagctgactctgatgtatccacctccatggggttgttgtctaagaataaaaggagatggtccataaaattgttattttttttactatctactgaaatcagaaatttcaaaattctctcacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctcttcctcacctcacactttcgattattgcaatggtggaaaccatgataaataaaagcgcttatctagtggtttggttttcactaaaattacagacttctgtaacattatttggataccataaaacacaaaccaaattttaggagatgctttagggtgttttttcccctgccctcctgtcggaagccctctatctttttactgtaatttatctgatatagctaccaagatgcttgatacttttacatgcaagggtgctgaaaaacaaagagcgagggaatgggttgttaatgaaattctctgattgtaaaaagcactctggaatgatcaggtggtaaataataataagaggaaataacataaagtgcttaggtgctacagcgatagtcaccatataaatgcagaagagatcagacatgaatagaatttgcattttatgcagctgctgtgtgtgtatatagaatatacagtagctaatttttcaataatgctggtaaaatattgttcaaaatctattcttgctgtcttctcactttaaaaggcattatatagaaaaacacccatctgtcctagtgcaatggtgaatgtgtgcaaagagcctagaaaaagagcctctttgcatacgtgaaaaaaaagaactcaaataaaaggagataatgaagaagagacaatagtaacactattagaacagctatgcagacaagcacaaaggtgatctttgaaaaacatcagggataaataactctgttaatgtgtggcagagaaactacagttaagacatacagtaatataccaaaaatatagacatgcttttattttgtctactgggctattgtgatagtgatggttgtttttgaatagaaaggaagaagagagtgggaagtaggatttcgttgtttgttgttactgttgctgctcagtttagaacaacaacatcaactacacaccagacccgtccaacagttccacaaacaatgcttaccatgaatctgccctcaattttcttgttgttattttcccttaatacttattgataacccaatgcccattcattagatatgctaaatcctcgtccatggttactctcctttggaagagactgagaagatgctaagagggagttcctcttacacataagggaagagtctgtttaggaatctgagaaagcagaggccaggataaagagaccactagtcaatcaatactaagcaccgaagactgaatcacccaaagatacaattatctcccttcctttgttctgtctcttagtcaaataaaggattgtttgtagaaccttttctgttcctgatctctaaaaagcaggactggacttgcacatccaactataattcaaaatatctcacacttccaacttgaaagaagacataaactgtttcaaagaaactcagagagagcaaatgcatattcacaaaacttacacttattcctagaataggaaaatggagagagaactaaccacataagaaagggctaatcataataataatagtaataatgatgatatcaatcaatactttggattctagagaatgatttatcacaaaaattcacctgtattaagggagactccaggacaaggaggtcattaagctacatttccatcttcaggattcagccaaactcagactctccggaaagctgtaaatgctctcagaacagactttagtaatgagattggaatgaacactgggcctatggcgtaaaagcatctccctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttgtttttgtttttttttaattatttgaagagtcacttgtctggatgcttcgttctagtagaatttggctgatttttttcccaacaccttttagtggaatgcagtaacagatgcatggagggagaattggtcttaacagtatttttaggtttcatctgtgtcagagagagatctcttccctttattgatttcttgcatacactatccacactacagcttgaaacagctacaacagtgtttgaaaaattggttgttcctcactgttcaaaccatttttcaaaacagtcgttacaagcttcattttactttctgttataaggagggttttgtttgggttggtttcattttccttgtggcgtcatgctagcagagaaacacagtcaggaatatagcttttaaatgtggtatgattgggattataaccatatcagaatctatattgaaaatttattagattgagccatgtgcagttaaaaagaaagaagtcagaagtcttcgatatttttcacaaacatgaacaccatctcatgcaaacgttaaaattcaccaaacaaatgataccccactgttggaaagatattttctcatgtcaacaactcaggaaggagtggggagggaatgggacatatacatgtaaaatttttctctatatttttgataataactctctgtgaatatgttttactacctaggtaatgcttatatttgtaaaaacatatagttatatcagaaagtcaattttgaataaacctgagaatggcaaactataatttttaaaatactaaccttttagaactgttcattttcacttttatttccaggactcactatcttaaagagaagaataaaagttgaagatccttgggattaacagaaagggtggaaatagccaaatgtattcatatttttggccaggcgcagtggcttatgcctgtagtcccagcactttgagaggctgaggcaggcagatcacctaaggtcaggagctcgagaccagcctggccaacatggtgaaaccctctctctactaaaaatataaaaaattagccaggcatggtggtacacacctgtaatcccagttcgggaggctgaggcaggagaattgcttgaacccaggagatggaggttgcagtgagcaaagactgagccactacactccagcctgggtgacagagcaagattctgtctcaataaaataaaataaaatgacgttcatatttttaaaatacagcaatattcatttgtttaaaaaacaagattgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaccaagattgagagcacagttatatagtgacttttgatacatacacaataaaacttattgaattttcaaaaagtgagaaaaaaactactctgctttaaatttaaagtaataaataataatgaagacatatcaacattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcacgagatccttttagaggttctgacacaaataaagtaaaagtaaacctgttgtggcaaagttactaactagtctacactaactctcagtccttgctcaaagcaaaataatggagtttggggtgcaatctggtgaactcaatggtccaactgcataaaggcaaagaggaaagccaggcttgggcacttctgtagaaaatgaagattactggtttgaaggccagtcttctcactgcttcactgtatgtggtgactattgttaaattagatatccctattctgatgaaaaggcaatgtgctatttttggggtatacatgtttcaagctgtaaactgcaaagtgctgtataaaagtaaagtggtgttaatgcctcataagataaacatatagattgatgatggaggcatttaaaatgctttaattgcccactttaataaagcactaaataattataataaaaacaattcttcagaaaacttggtgggaaaaaggcctacaggatatgtttgttaagaataattagattttagttttggaggaaaaggtaggacaagtcacaggaggcactcgatgagaagtcaggaatgcctagtacataagccacacatattaagttgtagtttcttcaaaactgacaataacatgtcctccaaaaccaaagggaaaatcaaaggatgttgcctatacttatgtaccttttgctactggagatctagtcaatctatagccttggattcatagttctataacatgacaacatagcaaaatctcaccaacactttgttttaaagaaattggcagctgggtgcggtggctcaagcctgtaatccatgaactttgggaggccaaggtgggcggatcacaaggtcaggaatttgagaccagcctggccaacatagtgaaaccccgtcgctactaaaaatacaaaaaagtagctgggtgtggcggtggatacctgtaatcctggctacttgggaggcagaggcaagagaatcacttgaacccaggaggcggagcttgcagtgagccgagatcgcaccattgcactccaacccaggcaacagtccgtgactccatcaaagaaagaaagaaagaaaaggaaggaaggaaggaaggaaggaaggaaggaaggaaggaaggaaggaaggaataaattggctatgcctccaagtgaattatactataaacttctttcccattaccaataatgtaaatatataaccaggcacaagcatgtggaaatggagaaaggatgaacgttagtcttagaaactttggtttgtatcccatttccaccttttaacaagtcatttagcctctctaggtcaagattttcttacctattaaatgaagataatggtacccatctcacaaaattgttttaagaattaaatgtaaaatgcttggcacagagaggtcactcaatacatggcagccaaatcaccacatgcagtaaaacccagataaaatatattcagccaggactgttgctctgtgagtaggtctggtatccatgctacaaaatctattaagcctaaataatttggtcattttagcaatactctttagagattttttaatgacatttcccaaaggtcaagctagcttatggttatgtggaactgctgcatttataagagagtttagtgggttcataaaataagtcttgctccccaaatccggatcataaagaccttctatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaaaaaagattcaaaatctgactctaaagcaataggtaaagaaatattttaaaatgcttatctgtaggaagaaaagcagtaaagcagaattcctaggaattgagaaacacttaggaagaaaatgcttaagtagtacgatccaaggtgaggctagctgcagaaaatacaaatatttatgggttaaatcaggactgaggaaaatataaagccaaatatgggcagctctgagggggaaaaaataggcagcttggtactcaactgtcatcacaattcatttgtgtttcacgtcccactgtttgtgacattaacagaattttgaatttagcaatggactatttttgtattgtgaatctctgcagccattttccatatgtagctaccactgtaactagcaataacagccttttgagctttaaaatgcttccaattaataagattcaaaataggggtcacctaagagttttccaagttaattccctttgtctactctttgaagcagagtggtattcctgctattcatttgcattgaggccaaattatttgaccatttcagtaagatatccttaggtagcttttgcttttattgtcattttccaaaggattaagttagttttagatttttgaactgcattttcatttaactaaaataactaaagcaatctttttatgagggtatttaaatagatcaaatttataccaagttcctactgtgtgtcaaacattagcaaagcaatttaaaatgttattatttatatatcaatacatacaaatcatatgtgttatatattaatgagcttatagccattatacacaggacttttatgtgttattattgttgtggttatttctgttgttcgcaggtatcagttatcaagtacctattatgttccaagaactctaccaaggactatacacactcaccatgtaatgaagatattattggtttattttccatttgaagatttagtcacaaaaagtaacttgtccatgagcatataatttgtgcattctcttaaaatcacttaaacttccacgtaacacctggattgacgtatgctttttcttacaaaatatacttcaattcaataaagattctttagtcacctactatgtggcacctgctaggatagttatctttgtttgctattatgctaaatcacagatctgaccattagaatctcttccttcctgaaaataccctctttaggtaaaactgtatttcttatcattttccatcactgattgaataaagaaaggtggcactatctggaaaacataagagcgttggatttacaagtttcttttaataaaacaaaccaagttaatcacaaattgttgcaacaaaatatgtgacatgaagggcatttaaggcacatttagacattatttctatctagaaacagaaatttagtccacataatgtcatttatctactgagctaaatcgtattacaattttcatctataaaatccagattcttaatgtgtgttggaaagataatatctctgacccgctctcagtaagaaatgtgttttgaattgttttgttagtaataataatggagttgtactggacaaaatatattttcagcaagtttctctggtaataaaaataactataatagtagtaataatactagtaatcaccaataaataatagatagcatttattgaactctactatgtgccaggtactgtgattagcactttacatgtattatcttattaatttctcaaaatattacatgaggtaagtaccgtaaatccaatttaacagaaaagcacattgagatatagaaatccaataatttggtaaagatcacacagatagaaaagaggtacaagtcaggattggaacccaaggaatctgactctcgtatctatctactctaggtgggggatatagcaggtgctatggtgtttgttcaagagaatactccatttgtgttgttttatctaccttattagggttggggcccatttggtctgtaagccaaatctgaagacagctgaaatgagttaaggtttgaattagtgctattcacactatctgccaattaaaatgctcccttctgagaagctgtagccagttggcataaccttaggacataatacatgctcaaaaaagtatctgatgaatgttaacaatggtttctctaagtggtgattttactttctttaaaaaatactttttcctattgtctgaaatattttcaacatgggcacattacttaggtgatcaaggggaaattcaggactttacttaaaaaatgtttttgttttgttttacaattaggttgttagtctcagttaaaacataactcctgctgggaagcctttcctgttgctgtactctctgaccttttgaaggacagtactccttactctgtctgcctcagaaccttatgaaggccacatactattgttaattatcagtcttctctgctttatgtgaagtcccttgaagattgaccccattacttatctacctcttagagctctaagcatcttgagtgcctaccactcagttcaatgaaaaaacccagaacacacatacaccagaacaagcacaaaagatgaaaaagaattattttagggttgacaatgcacactcttggtatttgcagatgacttgtttctccccttacattatgtgcaggtccccatggaaagaagtttcccacaagaagtgtcttgaatttactggtctcttctctggaggattttacaaatgcatcaaggaatacacacacacacacatacatacacattatgaaataatatgaggataattagaagtaatggggaacacaggaggcaatttctaaaaaatgaagcatattttttatatatataatgtatatatgtatacctgtatataatgtatatatgtatacctgtatatataatgtatatatgtatacctgtatatataatgtatatatgtatacctgtatatataatgtatatatgtatacattatatataatgtatatataatgtatatacacatacatgtatgtatatatatacacacacgtatatatatatatatatatacacacacacttttttttttgagacagagtttcgctttgttccccaggctggagtgcaatggagcgatctcagctcactgcaacctccgcctcccgagttcaagcgattctcctgcttcagccacccaagtagctttgattacaggcatgtgctaccacgcccagctaattttgcatttttaatagagacggggttttgccatgatggccaggctggtctcaaactcctgacctcaggtgatctgcccgccttggccttccaaagtgctgagattacaggcgtgagctaccacacccagccacatttatattttatattaagtaattttgttcctttcctaccccattataatataaacttcatgaaagtagaaactttattttattcactacagtatccctagtccataaaagaaggcatggcattacatcctcaataaatatatgtcgaaaagaaggaaaaaggtatagatgtttccactgtatttcttatatttttctggaaacaaaggggaaaggtgttcccaaaaggtttccaggaaaacttcaatcaccaatgaaactgcaagctcttgtcatgttcctcagaccactacctaattaattcctttatgtgcaatacatcctttctagcctgttgatactcaatttctggcgctgctgtaacttgtggagcaaagagtgccacgtgagaggtgcttgggccccttcatactgtgcctcacctgcgaactggggaggccactgccatttaggctccagcatcttttacaggccagctgagccaccagaagggaaggggagaaagagacatgcaagttctcagaatgtctggtatattcactcacacacatttctcttctcttctcaaaaaggatcctggcaacaaatcactgattaatgatgagagaaatggaatcaggaggaccccatgataccctctcatcctagttttgggagataaaatctcccactgtggggaggaggaagaccctacagggttttcttatgttttgcagcttccaaattgtagtagggtcctattctataaaattgctaccaacaactgtatacttagtgatataataccatatggaaccttgagttttacttaaagagtagattatgtggcaattcatagttatcctagtatggataagaaaatatcctagtaataacataattattctagttatgagtttttttcagacaagaaactcttttattcatctttttatctctagtgcccagactcaacatatgactttgtatatagtagttcttaataaatgatagcttaaaaattaaataatatttttaaaatggtgagatatggcttaaaggggttcaaacaaattcagagttttgtctaatctaggtgtttctagatttatgagcaggcaatcacatattattgagtatgtattagtgttttagttagtgttaatacagtataataaaccctcattgattgttgtagagaaatcctactattttacactcatatactagaaatgtttaaagtcacaattttaaaatagtggacttcaaactttattatgcacaactaacctgggcagtttcctaaactgcagatccaggctacattctcagagcttctgatttagaaattctggaatggggttcaggaatctccattttaacaggtgctctagataatcctgatataggtaatccctaggtaatcctgatacagttggtccttggactacttaccatggactaggctacaaggtaatataataataaatctatacagttcaccttttcaatacgaagagaagagactagcctattaaatgtgacttaactatcaaaattacccgtgaaaagaataggcaatttgctaagacttctcaaaatgaaccaagggaggacataagggcgagaaatattaaatttcaagccagaaatgactctttttaaaacttcaaagagactgacaatctgcttaaagtaaaagtggaagaagaatggcagcagtacagaagtgttttatgaacaatttaggaaagcaacattgattcaagaggtttatttgataacatgttttaatggttattataaaagtgaatgccttctaatctttgatttgctgctaaaatatatatgtatttatttacatgaaattttttttttaaattccccccttaactccctactttccacacatttttagcttgccaacattactgcgttaatggtgtcctttttttctctctctagaaacacatgccctgggattaaaaggggattactttggtctacttccacatccatgtcccagggaaggtactgcttctgcttccgacctgacctttaggtatctgcagccttcaattctttacagtgggagttgctttagcattgatttcttggaaaactaagagctgttttcaaaagccattttcaagacaaataatgaaaattattttcttatgcttatggatgttacaaactgtgtaacaagcttttctctttaactttgctgcaagaaagtttaaaggcaactgtatagcacttcactgaatatagttttatgctgacctcacttctaactccatttttatatcctttcctttattgttttatttttcttacctatttctaattcatgtattttgctgcaatcatgtatttatgtttattttttcattgtcagccattttaattcccttattggtgcaataaatagtaaataagacaaataaacaaaacaaaaacatatgtatgtatgtgtatttggtatttacatcgcatgtactcaaaataaaaaataaaaactaaccacctaaaataattgacatatttcattattctttgggctatagattcacttgactgcagcacttccatttagggagatataaaattaaaataccaccatgaaaaaatccatatgaaatttgacataggtattttcagccccaggtcattaattcagttctgactgacatctttcagttctgttttaaaatttttgtgttcagtctttcgattacacacacaaaaaagttttggcttaatcagcctaataaagtgtatatttctgaaaacatttttatgtaaacaaatatagaagtatacatgatacatacacatacattttttacttagagtcttcaaaccaaatatttcagtcctttgcttccagtattattttcttttaagtaaatacttttcattaagcaacaaagagtgatagtcatctcaacaccaaaaacttgtattcaggctaagtttagtctactttgcatattttcctctgagaatgatccagccagtctcagtctgattctagtaaaactcaggtaatgtggaagaactctaattgagtattagacattttaacaattatattcatattgatatgtccttatacgaccactctaggtgaaatattactatgcttgggacttaaatatgatttttgttcttttattaatttctgaatctcatatccttccagataccaaaggaatacagtaccacctgggaataatgtcaattttcactttaaaaaaatattttgttgcttttcccctcagcatgggcaaccaatagctgattcatactttcattacatcacagttggattacagaagggctctttagtctggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatgtcactcaactatactttgccattcacttaccatacgtcaaaaaggtggaataatactattcttacatagaggactaataagatatacttagcaaaagtaggtggttgcaaaacatttttttaaaaatcagagtgctgtatttttaaaatcttgcatagaactctggttcaatttttgagtccttccaatttctcataactctgtggtattcataataaagcaggcagatggttaagtctctgaacatatgctttaaatgccccctttgctatttctaaataatggaccaaattttgccctcaaatagtcacaggaaactttaaggaggctgcctcttgaaatctgaggacagaatgtgatccagtgggaattaaacctttaaaaaatatattttctaaactttcttatgagctctattccctataccaagacaaattacattttttaataaaataggatatagtaagagaaaaatcctaaccaatacaatattacttggctcaaggaatagattagaaggcaacatatgttttatttatttatattttaaaattctgattttctaaaacatgagagtcatctgattaatttctgtgtgattaccagattttccatttttattattattcctattactagtatcatgtagatgttatattgttaaaacatcttgcaattattaattagttaatttagtttaaattatgattatgcctttgttttaaatcaatgtttttcatagttattaaaagccaaaagcactatttttccagtcacttactttcatttcaaaaacagtttgttgtcgatgaaagcgcattttccaggttatcacagaatatgcaattcatctgcaatggatatatatattctggtaatgttgctcacataacctagctgtacttgtaagagtatctctgtttcttaatgtctatattttatacatggaattaaccttcatttgcacactcatatttctatgtatttaaatttattcctgaaagacctctgaactagtctctcctgtcttacgatgtccacaaaacttagcagtctgattaacattacagataaaaagaccacacaattgacaataaggacactttagttattatagacgtctgaagtttaagtattccaaaactataatgtccctttagaaattctcaataaggattagcttggtcctaatgaaaacagtgtttacttttaaaaataaatgcaatagttgtacccaaatatgttcgaaacactgtatgacgtgtcataatcaacaatgttgaaaataactaaagatctttaaatcaagtgataattttacacatatatccacaaatatctgaacaaaatttataattactattgggacaaaacattaacatattcttctgctaataaagacaaacaactttgagaaaatcctctctcattctcacgtctctaactttcacaataaatgcagcactgaaactaaatttccaactcagaaatacgctgagctccaataaacaagttgattttaaaaactcaccagactaacagttatgctttttcccttatctttcctttgctttcccttgttctttcactttccatgcacacacaatcacacttacctgcacaagtctgaaacatcagtctatgtattttttttgaaatgtactctgtaccgatgcatttttctgtgtttctttctaaccctcgagaatgttaagaatttaggaagagagccacagcttaagagtgcaattatttgccagtaaatactcaatttgcttgtcctgtgatttttcttctaacttgcatattcaataatccgtccctgactgcgtcacgagcacaaaaagtcttttctccaaaggagaagactttcgccaatcaaccttcagccatgccagggcacagcttgtcagggtgatttgttagctttaattaataattcctcacactggccattttcacaaataatgcagtgaggctgggaggctagattgctat

SEQ ID NO: 2231 - DNA, 421179 bp, Homo sapiens; identical to SEQ ID NO: 2230

SEQ ID NO: 2232 - DNA, 809182 bp, Homo sapiens
ttttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagtgaaatgagttcagtgatctcattctagtccttcgactcctgtccacatcactaagcgactgcacagcttggcacaggccaggatgagtcagcagtctctggtcatgagaggccaggcctggaatagcaggggggtttaggtcaggagcaaaatgaagcagaaaggcagtctagatggcagggctctgttctgcaatacacagaaatactgcaggtcaaaatgaaagcgcctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttcttccacatgctcccaaacttgaattaagaaatggtgacttcctatatactatcctagtattttggtactgttttcccaattcagtaagtagcaaaacaaataaaatgcaaggcactgcagttaaatagcaagaaaagcctcatatttcataaaataatatgagtctgatatctcaaaggtgtacatttgggttaatagtgtctgtatatagcctgtatgaaatggttaaagaggagtactctttaagttgagcttgggtgggggtagagaagagcttagagaaaagagagttaccagttaatgataaaacataggggaactatgacactgtgaccatatttctactcaatggggccaacatagacctccattagacctccatcaagaagtgatgctcccactaacaggacttcaaacacttctccctctgcagtagtactgtaatatagcaaggggagagggaaaataaaatagatagaaaaacaaggttcaacataaaaaaaattagtgatagacattttgtttcagaggaggcaaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttcagagggtattaagtcatctgaacacatatttactaactgtttaatcttgggcaaatgagctttctagcctcagtttctctctctttgaaatggaaataatattatcatcctcatggaatcattgtaagcactgaatcaatgttcattaacccttatctcagcagtacctgtcacatggtgaacattcagtaaattgcttattattcatattatttgattatcatatcatatcatctttataagtatccagtgaaagaatccccctccagtgttgttccactggattgagaggaatcaatatgaagactctagtaaaatcagttgagtaacactgcttacactgctgctttaaaaagattatttctgtctgggtatgttaaacattatacttgaagacacaggatgttgaaaatctattatgtgaaatccttgaatttgggtatctatgttgtcaaagcaacttggagcctaacagttgtccagtaactagaggcccaaaaaagaaaagaggaatttttagaagcttctccaaaagcaacaggataaaagtgttattggccttaaccgcatgatgagggctttttaccaaaggggaaaacgtagtccagttgatcatcgcagcctaattgattaattgtgggtctgaccatctggctgatgaatgctgacacccagcagtgattactgtgtaacacaattccggatgtgctctccctgatgcctcccacaataatggcaactctgaacttaaggttagtttattcaggcctcttggctcaatctcttcatggaatagtggttgtggcagggaatattttactagacctggtcaagcattatcttctcttatttcagttacccactcttttccaactctactcctacccactcctaagccctctcttgtatataatcacttttcatgcaaagcattccatctgtagttttcatcatattatctgattctctcatttctggttgctctgttctgaaaaatatttgactaaactaggagatctatactgctagaatgccatttcacaggggatcctattgggacatgtttattgtatcttatttgctactggtttacttcaaattactctgcgcttccaaataaagaaaattattttacctaattcattagcctgattaaaagtcccacatatggcccaagttttccatgagattatcagaatacaagggttaatagacgataattcttacatcttaagcctacttctgaccctcagttaggagtatcccatgaagaagattcccctggagcatactttactgttagagaaggaaagtcagacccatgtaaatgacaaggttcaatagcaatgccatccacaaaccaatctacacctggagatgacttgtacatggagaattcaccaagcaaataaaacctgtacatataaatataaaccctggggaattataacaaaataattccattgtattttgtaggaatgcacaggggagtaactgacacaaaatatcttatacaaccttgaccaacaagtcacaatgacaaatcatccgtttcctcttttcttttcccagattgatttccagctctaaattcatcttttctttcactccccacagatgctgaattcttctatgttccaggctgagttagtgttaattttcagtagaggacggcagtagcatgctgaactgtagagttccgggctgggagttgggaaatgtttttggcctgactgtcagtaaacaactatgtgtcttgggcaagtcaagtcccttaactccccatgtctcagtctcttcattgaaaaatgatagggtaggactgcataaactccatagtctctgccaacactaagattctatggttctatagctcatttccttttttttctccctttggcatcaactgctcaacaactccgctcatagtaatctctatgctctcagttactaatggaaaaatatgtccttcatttactagttggtattttgtatttgtaatctctctctttttttatttgatgctagatattttgagtcataaacaccaacatatccaaatagatgctttaaatttgaaggcgtttaaggaaaatagctttcccatgtagaatatttagtgtagcagggcatggaggaagccagccatccaaaagtggagcaaaggggccaattcacaaatgagagaaagcctttcataataagagtctccacactctttaacttagataaagctaaaatgctaccaacttctaactacttttccaatcaatcccagacaccatcacagacacttaggactacaaatctgaggaccagcactggcagcaatgcagttcttatttcacctccaccacccattgccaagcaggatttaggatggcatactaataagagccaagaggacgatctgtcatttattttcctccaaactttttgaaatttcccatttgggctctgtttcccagttttaatttggtaactgccatttttcagcatttcttttaacaggttactaataatttctgatacaggatctcatatttcattttatgctgctagagctgctgttaatatttcatctgccttcaattcagctctgaataaaggctgctaggttttgatagactgttaacactttggttctggggatttgatcactatgttcatccagtttgtccatattttgttaaaaaaaaagtaataggttagctatctcagaaatatctcagggtgtgctatacattctagggatacttcagagtttctttttctggatctttgatgaaaaccaacaaaaacaagtatcctgggtttgttttcacaaatgacttgccatttgcttcagtgtcagtattctggaagcagtgggcagtggttaagattcagggctcataggcagatctagattcaaattttggctctgaaatttattatatatatcacctcaggccagttccttaaccttgccaagtctttcttttcccatttgtaaaatagggatgataataatatccacttctattaattaatatgaggatccaataaattaatataaagtgctgaggattttctcagttctcaataaatgatggctatcattatcctagcattaataatctacaaattcacattatagaattattattttgcaacatcttttcagggtcaacaaattattttttagtacagcctttgttgtttgcttcactatagcttacatttttaaaaagtctcagtaaaatcatgtaaaatatttaaaaatttgatatttaaactgtatgtacagttagactaatatatagcaccatattattattattgtagcacttttcagtgcagcagcaaattctcaaaagtttttgtccatctaatagccagccctagataaggcacattgtaccaatactaatctgttctataaaaagatgacttatcatatttatcttctcctactcccaaagaatatagattattttaatattctttgggtatgtgtcagtcaggccctgtttggatacagagaccatatagcaatttgaatagaaagttagtttaaattattaataataacgggattaaagtaataagagtagctagtaagaagtaaagaatactttaaagaatataagaataacatgggccaggcgcaggggctcatgcctgtaatcccagcacttagggccgaggtgggtcttcagcctaggagctgaagactagtttgggcaaaatggtgaaatgccgtttctacaaaatattagtcgagcatgatggtgtgtgcctgcagtcccagctacttgtggggctgaggtgagaggatcgcttgattccaggaggttgaggctgcagtgagctgtgttcatgccactgcattcaaccctgggtgacaaagcgagaccttgtcttaaaaaataaaaaagaatagaagaataacaaatgtaaggaacagccattatttgcagggctaagatagcatatccaaggaagagtctcctccatccctggactgagatctagacattgtaggactcaagacaaaaatctcctggacccctggaccaggatccagaccttgttggacaacacacagccataactcattggatggcagagaagttgctggggagctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggagaagctacctgtgcttcagctgctgggtaccaggttagctgcatttgctgcaggagctacatgctgtaaaggttgcttatgttgtagaagccaggctctggagaaaccgtgcacattgcaggaggctgccaaagtagtgcatgacaaccaggaaggaaaatttcttctttctgcaacgtctccctaccttctctactgacaaagcaccctcaaaccagctagcaaagaaaaaatatttaaagaatccagatacatttttgcagagcaggcaaggagaactacatttggaaggaggcaatgggaggtaatacattggtaactggcacagatattattatttgctcacacacttcatgaaataactcacattagagattataatccagtattttcaactgattgcactactgttcacatttactaataaaccaactccctttgcatagttaagcaaatactgtcagaattaagaaaaataagaggccagtagataaatacctataatagaatattttaaagtgacagtactagtatatgtacataaccttttcccccaagtgctgcccacatacattttaattacatgtttataatttacttaagaaaaaaatatacagaagtactaagctattgacctaaatgtatgcatcagtgatctcacaccagaatctcaactaagtgggtattcagaagagtcattacaaacaaccaaaagctttgagagaggtaaaaattgcctcgattatcatttttcctttctctttccttttctttttaattaactctagaactcatatttgcttcttctatgacatttttgtggaggggtggggtggctcttaaataggttattcttttttttttttttttttttttttttttgagatggcgtcttgctctgttgcccaggctggagtgcagtggtgcaatcttggctcactgcaacctctgccttccgggttcaagcaattctcctgcctcagcctcttgagtagctgggattacagacatgtgccaccacacccagctaatttttgtatttttagtagagacagggtttcaccatattggtcaggctggtcttgaactcctgacctcgtgatccgcctgcctcggcctcccaaagtgctgggattacaggcatgagccacgtgcccagcaaaatataggttactgtttttcagaaaaatacatatttagaaattttttcttatgattctggtcctatattgttctactcttaatattaaatagagaagcatcaataaatgaccaatttggtaaactatgatactgtgatcattgttagaactagttttacatatggggagagagtatattccaaaatacctcccctacttttgcctaattcccttaagaagggaacaggtgcttttgctgtataattacaggtagagtttaaaaccacaaacacctgacattagcaaggagcgtggttgtgagaggctgagagcagaaaagctaattgggtgaggagagtcctgtagagagtagactatactgaggtcaggaccacagaacatctttctcaccattcatccgtttttacctatgtctggccatcagcactatctgttctcactattatggaaggggtctacttgttacctcacagttgtgttttcttaaagccagtggtatccagcaaagcaagccatgttgggttgtctcacaatcacactgtaggcatctctgccagctgcaggtggttatccttatgatttccttttgtttgtgctatgcgtgagtactgaggataaatttaatgaccctatgtttagttctctcctccaacacacatgcacacccccctctcccctgcaattcctgagttcaaaaagagatgaagacaaaggaatgtcataagtccgtgtgattcaggcaggcaagtccattttattttagtttgcccttctgttctgctggcttttctgctatgacccactatacttaacctgtcggctgttcttagtagcaacatgcctttttaatcagccttcctggggtctgcatttgattacagcatttgtgttctattttgattcttttgtactgtgccctgtggtgttcgcttgaaaggtgttatttataaaatgaaattctattgtattgccacttggattcaaagaggacatataatattaatgcagaatgtatttaataatatcttcaatctattaaatcaatttcttcatgagaatacagaatggaagggaggcacatgggctgataatcaggtaataagacttaagaatcacctgaacttttccttcacaagctttcctgaaagctggcacaagaatcattctcttaatgtcagggtttccaagtggaggagactacctttcttcagccagaccagtgcagtgcgcacctgtttaaacattcaactgtgcaggccaaacattttcctaggcttttagatgcaaattttttgactaaggaaactatgagaccaaacatgaatatgacttttttactacatagaaagaattaggttatgaaggaaatgtaatcacctatttctaaggatctactttcaagatttgtaaaaagaagtatatttgttctcacactgactcttctcaaaagcaggataggaaaattctagtgataccaagaactgatgcaaagtttccaaggtggcatgttcagaatgatgttctcacctagcaaaagggcaggtttcattgtgggctgctgggcctacagtcaaatgtttctagattagattgatggaggagtccccaagttttttcaacttctaattttaattccagctaaagactgaaacattgtacactgtatcacagcttgcacagcacatttcttgctgcatacattctattctttcactacaatttttttttcctgttgatctatctgaaatcatcaatggctatgctgctgtttggatagggaataagaaagaatttggtttgaaagatgatttaggaatcaggctctgcagaacttactaaaagaaactgtaacatacaaaggaacctggctgggcagtcttgaaatgagagttcctggatttttacctgttctcattcagtggcatattatataactccagaaaaatcagggtccagttttctaatcactaaaaggggaataactgtccttttctacttgcactgggctactttagggatggataagaaaatgattccagaatcttgtaaatgctttgcaatgaagaggaaatacaaatgcacaatattattaaaatgatagtttaggccacatttttgtttctccaaatctagagatgaaaaatagtaacaaaggaataaatttcttccacttcaaaaataaataatatacccttatttataaatgacatgtcaaacataaggaactaggatgtgttggggaatacacatctcagttttgaaggcatcaaattataagctatttgcatgaaggaatcacattcatctctgtatccacccaagttctacctcattgatttacattatgtaagtattccattcgttaacatatgttgaattgaaatgacaaatgagatcgcacaattttagagctcgaattaactagagaccatgttaaatcctgttgcctcattttgcagatgatacaactgaggcccagataagtaacttaactaagtccaatactaaaaatattacaagttttagaagagttattttaaagatctgccactgaaaatatatcactgaattaaaacaaaatagacattcttctgtcaaaataagaagcactattcagctcaaataatccgatgtatcctaacctaatcaagaaggctgaagcctaaagtaacaagtaaacataattaaatagctatagacccataggcatgttagaaatgccaagttactgaggggtgcatatcttaatactttgtctatcagccagtccaaatggcatatttttttcaagtaaaattaatgtcttaacaaataataggggtgaagtcagcaagatggcagagtggaaaactctacctctcattcttccacagaaatactgataaaacaatgttggaaccaaaataccttgcaaatatattcagattgtagctaagaaatagaggcaccctagaggatcccaaactaaaagcagttgcatttgcatgggtaaaaagtgcaatttcatgttagaatgtcatatcagtacttcccccagactggcttagctcaacactgagaggactgcttcagctcatgatttctcctgtgccacagaaagtgagattggagtgtgtatctggcttcctggcctctggcctctcagagaaccctctgttgggtcagttcctatattgcctcatactgtgtactgacgcacctgtagaacttcgttcccagggatgcgtaggagcaaagaaatgaggagggcaactccttacagttagagctgccttgcaagattaggaatggggcagaactgaggttattcttagatgagggaggaaagggaatgaagggggccttattctcagcatttcagagttccctctgtgaagccagtttccatttcaccttgtactgagccttgtgcgaccattagaacttggttctgagggatagttagcaaaaactaaaaggagcaggcatccctttgcagctggcactgctctgtataataagaaaaaaacatagaaccgagccttttccttgagaaggcaaggaaagaagtgtaaagggccttgcccccagtcttagattgtgctccccaaggtgtatgtctctatcttgtctcatattaagcaccatgaactggtaaaggtctctactcatcaaaactcatctgtagagactgggaaaggtagctgctacttcaaatatacagatcacaaagaaaatctacaaggaacacaaagagtcatctccaataaccatcctgaaagaaacagagatccctgaattaactgacaaagaatgcaaaataaatgtcttaaagaagcccagtgagttacaagagaacactgagagatagctaaataaaattaggaaaaagatacaagaacaaaatgagaagttaaataaagagatagagactattaaaaagaacccaatagaattactgaagctggagaatacaaaaattgaactgaaagattcactagaggagttcaaaagcagacctaatcaagcagaagaaagaaacagtgaacataaagacagatcatttgaaattatgtagtcaggagcacaaagaaaaaacaaggatgaaaagtgaggaaagcctaagtgacttatgggactcaaacaagtgaatcaataaacacattagggaattctggggagaagagagggaaaggggtagaaagcctatttaaagaaataatggtaaggaacttcccaaatcaggggagagaaatcaacatccagattcatgaagtccaaagagctccaaagatctacaccaagacccattataatccaattgtcaaaagtcaaagacagaattttgagagaaacaagagcgaagcaactcatcacattcaaaggagtccccataagactgtcagcaaatttctcagcagaatcctcacaggcaaagagagagtaagatgacatattcaaagtactgaagatcaaaaaacaacaacaacctgtcaaccaagaacgctatactcagaaaagccatccttcaataataaagaagaggtaaagactttcctagacaaacatgcagaggggtgttcaccatcactgtacctgctttgcatgaaatgctacagaaagttctttaagctgaaatgaaaggatgttgattagcagcatgaaaagatgaaagtataaaacttgccaataaagtcaagtatatagtcaaatactagagacctctagtactctaatgatagtgtgtaaatcactttcaactctggtataaacattaaaagacaaaactataaaagtaatgacatgatttgttaatggatacacagtataaaaagacgtaaattgtgacaccaataacatgaagtgtgtatataggagaagtaaaagagtagagattttgtatgtgatcaaatttaagttgctatcagcttaaaatagatgattataagttgttttatggaagcctcatggtaaatacaagaaaaacacctgtagtagatatataaaacataaagagaaaggaatcaaagcatattgctacaaaagataatcaaatcacaaaaaaagacagcaacagagggacaaaggaactacaaaacaaccagacaataatttaaaaatggcagtaataagttctcacctattaataattaagtgtaaatggattagcttccccaatcaaaagatacaaactggctgaagagattaagaggaagactatccatatgctgttaaaacagcaacaacaacaacaacaaaaaacaacaacaacacactttagctttagggacaaacatagactcaaagtaaaaggtgggaaaaatatattccaagcaaacgataaccaaaagctagtaagagtggctattcttatatcatacaaaatagactttcagccaaaaattgtcacaagagacagagagaaggtcattatataacaagaaagtgattaattcattaaaatgatataataatccccttgattaggatccttttgattggaatcctcttgactggagtagaacaaaaactgaataattgtaaactattattatgaagtagagatctccaatacactactttttatttttccaaagctttcctggagatcacagagaactgaacatggagaaaaagtgagcaagagacagcagtaggctttatgccttaaatggctgtatagcttgttaaagattattgtttgtgtattaaaaaaacatgattctagaaacataattggggtttcacagatcaaattcaaattattaacttagtatttcagcctccattacttgctctatcttgcttaggcatcctaggttccagtacttcccaacaagtgttctgtggtgtatgcagactatgttagtgtttccctttattttggtatttccacaggagacctaattttaaattttctgttctatcatctccatgatttcttaaattatgtctagacttctggattagaatattattcatgtacttactatgattcaataaacatcttctatgtgtgagacagtaggaataagatacaaataagacttatttcctatcttcaaagaataaaggaattcacaatacagtggccacttaaatatataacatgtgttcctgcttttaagcttttattctttctataattagagtatcctatcattattttattgattgaattcctttaattatcttatagtccagcttatgttctgcttcttccataaattaatttttactttttatagcccacactgtttccttttccccccactattacagtggaagtggacactattccctaaccaaacttcattccctcattcttcctagccgcagacctctattttgtgcagagtgtcaatgtgctcagtgctggatgatgagttttgaaatttataagccaattatgacaagtgtattctctaatttgcttgcttctctagcaaagaagggtggcctagggattcagttatagccaataagatctatgtggcaatccacttgagaggcaagtttctgagaaagctttttttttccgttacaaagaggaaggtaaaaggcaatccttctgtttcctcctccttccctctttgaacatagacatgatgcttggagttgtggcagctattttgtgatcataaagtgacaagcatgaaagaaagacaaaaagaatcccagagatatcagcacagactttatcatataccaggaatttcctacctctcaacttctggacttcctgttaggtgagaaaactgaatctctatttgtttaagccacttaagtcaggatttgctacctgctgctgaacacatttctaaccaaagtaataatagtaacattcataatttgaattcaccaaactgttcttcctaactagataacagacattggtcacattcttggcacttcataaacattcatttgcttcacatcttgattaaatatgctagacttttatatgtaatgaaattctcacacagaaaggaaggggggaatttggattagtatcagaaaagaggatgaaaccaggtcaaaaaaggaaaatttgattctataataaaaaattatatgacaaaaatttgttacaatgtagctcaattattatatacaataaaagcaaatttttaaatattttccaaaattaatagcaacatattttaagaaataagacagtagaataagcccccaaatgataaatgttttaaaggagagatgatataaacaagtcttctattaaatgtgaagacaataccatgcagttctactgaaacctaagtgaggaaccagcgtttgtcaaataccaccagcaataagactttttctctgtcctttaggttgtatgactgtgattcaccccaatgctacaggctccttagcatgctcattatttctaaaatctttcacctgaggtttgaacccatgacttaggaaactattatcgcatttgcttttggagaaaagactacataagttgggacagaagctattttcaaggcttccaaatattacaagtaagtagtggggaactgttgagaagagaaatgagtagctttgggtcattttaggttagtgaccttaaacataaggtgtgatttaatcagaagccagagtaattatggcaggaggtggggaaaaagactcagagctgtctggagttagggaggactttggtggcagctttcagcttgagctaaaactgcaggattctgtcagaggctccacaaacaaagggctgcattatgtaaggaatcttgtatttctttgtgaactagtccacaacaaaatttcattagtttttttttttttctctcctagagatttttttttaccacttccagcccgtaacttgttgctcagaagggaaactttctaccttaaataaaagtttaaattgtaagcaaactgacatttttttaggaacaaatcaaattaatttgaactttataataactgggaaaatgctttttaagttaggtggatgataagtaatcttatatgaagaatttccaaataatttagcaatagttggcaataatttagcaatagttagcaatacgagttcatatctctctccctctctgtctctatcattttctgatagtctgtttacacatgtaacacttttgggtcacctttcaatggagcatttcataggcagaattggaagatagcaagacacatggatggcacatagcaataggttctcataaatattatctgttttcaaaagaatatttatttttttgcccattataaagatattctaagattaattacagtcctaatactgtcaaatttagctttgatatacaaaaatctattttttagtagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtggaatgaaggcaagttataggtaacatacaaggattttcattctgctggactttttcattcaaaacagcatcattctcagactcagaattatggataaccatgcctctcagtctactcaggagagtttccagtttcagttccaatggcccagtcacaattattagtagtgttcattttcactttcaaaagtgtcctagtttggatgataaaatatggggttaccctgtatataagctttaaaaaagttagtcataacaccatttacagtgataatcattctatttaggacaaattaaagtagactctattggccaacttctataaagagaaagagataaactaaaacattattaatttaatctcagagctttaatcagaaaaagtttattttaagatgacaacaaaatttctatgaattatttaggatttctaattttaggtcatttttttttagccttattttatacaagcaagcacgtatgcccttaagatttgtggtggagaaagaagtacaatatctgaaataaagttctttgaagcttaggtttgaattctaattctactatttactcggtgtgcaaatttaaataatttctgtgaacattattattaaccctttctaaaatatgtttaaaaacattttaaaaaccagaagggaaagaactacatatgctgtgaaaagctgtaagttattaacagttactattatttctctttataaataatgatagtttttccctttcaacttctatgacacttttacagactgtagaaaaatttggccaagcatgttgtagcaagggtccttaactgtaatcacctttgacacagatccatgatatttctgggtgacatctctacatggacattgatggcctgcaaagatctagaaaagaaagactatagatcttgtacaccaaggccaaagactaaaaggctgaaatttaaagtacaaaagtattgtgaacagttttgttagtagtataatatataccacttatatagataatttttcttatatagatataagaataatttttcttatatagatataaaatagggtttcttatatagataatttttccatggaaggaaggggaaacgaggcgaaaagtggctggagtagaaagactagtttgtaaggcagaaagattttctaattactaggtagattttattttattttacttgtttttactagctaaattttaaaaaagagattcctagatctctatagacatgttcctctttctttttgctgatattttcctatttcttttctgaaatcttaatttgactagaaaaaaaatgatgttctgatttaattctcttagtctacctgacatcaaaaagtatatggagggtgtctttagttttttatttatatgaatgtaatcaaataattttattttttaaaaaaagactctcactgtttttcattgtttaacagacatttctttaaaactttgaagtaattatagaaaatgttctcataaattttccctccaaattaaccaggtagaaagggctaatcctgttatgcatgccatttttgtttgtttaaattgactattctgagaattaagtctgtagtacctagtttgaggcctcaagattttcaggtatgcacaaggttctatcaactaattctttgtctcactgatgatcctttattttaaatatactctacttgcaaaggtggtagggtaaaaagaggagtggctgacaagagactaaagaggggaaaggattcccaacatccttaatatctcagggctgaaaaagagcattagaaatcttctccaatctcttggagaaaaaatatctttcacacactctgtctattagaacttcatttgtgtttaacaagcccctcttttaaaatgcaaatttgccttgtgaacctgtaaacctcattcacaccttattgttaattactttgatgttctagaatatgatcaacacttaactgatattggcaatctaggaatgaacaaattgctcagggtgaaaaaaggaaaattttgttggagtggggctgtaggtggtagtgtgagaatttcatttgtgagaaatagagcatactgatattctgaagttttgtctaggagaatggcagtagttacggtaccacaaaacgagcacttttcccgactgccgatgtctagttgagatcagaaaaagcctggaagcctgcaaacctaagttttaaatatttagccatagcaagctaatcaagcttgcaattttctgaaaacgttttaagttaattcataatagctctacaactcggtgaccttgggttctaagactcatttggttcaaccttccaggtttaaaattcaaccaataaatgaattccaaggaaaaaaagtgaatatggcccagtccttttttactgtctccctagtcattcacttcagagattttggaatgcaatcctagaacatactgtaagcaatttcagaagaatacacaggatgcagtatttctctatgtgtcttagtaaatgtcacttgacccgatatatcaaaaaggttgcaaaatttgaattagactttagttgacttaagctacacatcttagcttggcagaaattcaaggaaaaaaatattttatggcctcttgtaacattattaatcacccctccttttatataaaaaataaatatgctaaactcttcactgttcagaaaaggggtcatttttcctgccaaaatggctaattttagtttttatgtagttggatacatttgtaaactattacatgaaaacatatggttggaacatgcttactccttcatgagtgttccccttttgaggctgcaaaattttccttagttgctccatgtgctactttgttgtgctgatgacttcttgttctaaataattttcttcattttccattgttaatgaaatgagttctaataaggaacaaagaaaccctctgatgaaaatccctttcttgtagaatggactgggaactgatataggacacaggggaacagcaaatgctgtgttgcacattcttcaattaaatgatccctttgtagtttattcacctgaatgcattttggcaaagagtgaagcaatagtgggaaaaggattgtttgtgtggctaatctttggttactcagaaagtactagacatgttttcctgcatgtttgattgatttcctgcacagtttgattggtgaatcaacactttaaggtatctaacccataaggaagagtgaaaaacttccccagaggtattgaaatttcactaaacctcttcttggagttttggtgtatgattctcagttgatctttgagtgtaacagtcaactattaaattggcatgactgaagtacagttttttcaaatagaagagtattttagaacaaatgagaattctaactctttaactgaatttctaactttacattttgcccgtacctctccttgtaacattcttccctttttccctatatatttttaccagtaatcctttcaactgctccttaacagtgagattctactgttctggcacattataggttctctttaactattttttgagtgcacaaatgaccatttggacaaatattataaaatgaacaataaaaaaccttaattatgcaaattaataagtctatacctttgggaaaaaagccatgatagtaacaaaatgaataacaattccaaggatatttaggaaggataaagcctagaagattaaaaatgagaaattttagaatcataaaaaacaaaacgaaataaaatagctcaataccattgaaagcacatgtatgcagaaagaagctaatatattattgtaaaaaattaaatggaaagaaattagaaatctattggtattattacatcaaaagcaggaagttctttctttctggtccaactttagagagaagaacaaatttgccagtgccaccaagggcagaatagagagagatgtttggaatttaagagttacaggttatgttatggttcatttatatcattgccatcactgcagttcattcattttgtgtctaattattgatgttgccacggttgtcaataaacgctcagcattactaatcatcagagaaacgcaagtcaaaaccacaatgaaataccatcttataccagtcagaatggctgttgttaaaaaatcaaagaacaacaggtgctgcatgattgtggaggagagggaatgcttacacattgttggtgggaatgtaaactagtcctacctattaggtactgtgctcattaccataggaattagggtgggattcctattccaaacctcagcatcacacaatattcctatggactaaatctgcatatgcaccctctgtatctaaaataaaagttgaaattttaataaagatggaactaatccctcatatcacagaattatgtagttgtgggtagtcaggataaagaatatttaggatataatttaaatgaattcactagctctgaaaatgaaagaataaacagaaaactaatctagacattaaatttttttctttccctaaggataatgtatagtccctaaggataatgaatattcaaggacatactgtaataaatcatatacatttattattaatataatatagtttattgcacacacacactatgagctccacgatgttcgttgaactattacaaagtttaaagacatacgaaattacagtaagagccatccatataaaaataaaatgttagtgtttggaaggaccaattgtaggagactatattggcgagttaatacaaaagatcatcttttgtttaagagttcatatatttttgtgtaaattatatctatttacagaaattttctttactaccaactgttctcaaacccattcactaataaataattactatatgtgattacttaatatttacctcaaacctttatgaatatcactgaaagcattactggcaaattaattatataggcaaatggtgaggatctctcaacctcacctctcaccttcttcccaatcactcgaagactgactatatcaatttgtcttgttatccagaaattggctttatttgttaattccagagatgcttcaactgtagtttcagccagctgtttccttacatctttctgggtggcatcagtttacaatgcatagcattgttgagggtcaaagttattttattttggtattactattggatttttcccccagtgcctcaaaggggaatgttgagtcatggagatgtaatgtgactccttaaactaagtagacttctaatacaagtatacttttattatggagaaaccaaattaattttatcaattaaatgagaatttatttaccatttgcctttaccagatatttcattagacacaattctcagactttacacaattacaaagaatgttgtataaaaactatctataaagcaggagatatttcattcttagttttttgccaaacaaattatgttgcttcgaggaacagagggaaaagaaacattgatgaaacacagccctcaactatggcataaagtccaaagcacagagaaggtcagaaaagaataaagcagttttgcagaattattatgatagggagtactgataaagaagagtcaactttttggccttagtcatttactgagttcctttattaaaaatagagcataaacattttagaaataattttttctcaatctttttttataaaacctctacagaaaaaagaagcgttatgtgaaaagcagctaaatgggaggaaagtaggggtctgtgggtgaaacaggaggttaccattgcaaaccctgtccttgatgccctcactcagtaggactggtggatggaagaagtttgaaaaacttttatgtagagatgaagaaaagtagaagccctagtttacagagaacgaaagatacatttttcttctgtgtaggtagagtttgtatttggagaaggaggagactcctttcttctgatgaaaactccttcttccaagagaaaactccattaggaaaaatggagcagcagtgagtgagagagaccaggtttaagatttgttttggaggttaaatttgttgtggaagttgacagaatgtggtgaaagcaagacacatcataaaataagccaaaaaaaatctctctcttccagctcattgtatattggagagttagttgacttttctactgtaaatgtaaagaaaacaaaagtttcattcatcctcctgtaatgatgccaatctaatttgctattaaatttctattcaaaagccctattttgtttagttacaagggatttgatccccttaaactttcccaggcaatttgtatggaaaggcggttgctaagggtattcctaagggaactggcaaacgttggaagataaataacctcagtacaatatgcagattaagtagaagggatggtttaagagttaccttttgaaggaaaaataaaagattcagaattcagggctagagttgctagttaatcactgatttgaaggtacttaatcaaggcagttttattttattttattttatttatttatttttttttagacagagtcttgctctgttgcccaggctggagtgcagtggcgcgatcttggctaactgcaagctctgcctcccgggttcatgccattctcctgcctcagcctcccgagtagctgggaccacaggcacctgccaccacgcccagctaattttttgtatttttagtagagactggctttcatcgtgttaaccaggatggtctcgatctcctgaccttgtaatccacccgccttggcctcccaaaatgctgggattacaggcgtgagccaccaagcccggccaaggcagttttatacttctcaagaaagtagaactttcacattgttcctcttgggaataaaggtaaaattatcatagagaggaaattagagagaaatgttcaccatttccttccttatattcttcctttctttcctctctctatctctagagctcttcctcaaagattcaaataaccaaaaatatgaagccatgggtggcagcttggagttctcaaaagtccaaagtgaggttagcttctgaccaaaacttttggcaatttccttaggttgagtgaaagaagcaatgtgaaaaagcatgagtttagagtcagtcagccatcaatttaaaatcaaactccactatttattattggtgtgatcttgaatacattagccaacctctttatagtccagtcatttctaaagaggtgattatctatgaaacctgtattacatatacaatgtgtaagtactcagtaaatactcagtacttctctagtatctctctaattggatttggctagtaatcatgacaattgtgggagagaaaaaaaaagatatgtaatcctgagggcactcagtctctgtaacaatcacttgataaataatcaggtgatacttcgttgacatctctttaatcttccaattgagaaaacattaggagtagaagaaaaatgattaatctccaacttctgtcattggaaaataactaaagatcagaactataagaaacataaaacttttctagattattaaagttaaccttttagacattttccacaatcacatggtatgcaaattttaactaaattattttacattaaatgtattttgtgctatgttttgactagttgattttactgtagtatagaatgtattatgacattccattatcctcttattactcatcaataaaaaatttattgagaaaacaattaattataattaatatttattattcattactagtaggcattgtagtaattacactattattggtattttaaatatcattaatagctataaacatgttatacataataataatagaaaccatttgtggagtgcttactgtgtaatacattttgctaagcattttatatacattcttaaaattaataatttcaaagatttaatgagctaagtgtcaccagataaacgagaagacataataatctttatttattaaaggaaaacttgccatatccacacaatcttccaaagcactgatagaacagaatgatggcatgatggcatcttaaatttagaaagtgtcattcataaaagtgtactgttaactactaatttgtgctatctgcaataataatattatattacacaagatggaaaggctaccccctaaaagatagcatttgataaattgtacataaaaatctagaagaataagagtataacagaggagtgaaatttgatctgaaatacagagaaaattaagaaaaacaaaacatgttagccctactggaatttgtctcaatgtatttcaaggttcaaagtatagcagaggaagatcattgacactgtcagaggattatcattaaatttcaacccaaaggcaactaactcaaactatgcagatatggaaagtagtgtttcctaaaatgaaactaaggcaaatattatttattctagcttctactcttttgactaatcagctgacccagaaattaaatatttaaaggcttaaaaataatatagttttaagaagttgacctatacgttactaaataaaatgatcctcgttgtatttgaagtagctcaccatttaaaaatttaatctatgtccacccattttctttcttcccaaataatacaatgatttaattaccccacagtttaatttgacagaggagccaaaaagatacactattccttcattgttaactttaaggagaaaaatacactataaactatattagaaatcttattttttgggtgtccaccacaatgttttcactacaaaatcccttgctgcctgaatacaaaatgttaccattcaatcagatgagtctccatgaagttagaaacattcaagtgaaactcataaaataaagaagatatactctaaaaattccagttcttgagaagctgtttacacacaaaagggctattaaaagtgaaagggtaagtagaaaatcttctgggctcatttaataaaagaatgtagagttccatgggattcttttctaaagaaaccactaacaatgttgcagatctacaaatcctaaaagagtgcataatggactcaagtctctgctttgtgactcatgggtgtacttcatcaggatgtacttcctcttttagggggtcatataggtgaataagctgacaacaccttcagagagagaaattccacatgtgtcataggaatagaatttatttgatctcaagctttctatatatagaaaaaaaacaaattctaatccaaactttaatgaattcagtattgttgttgttggtttgcctctagaatgtctcttttgaccaagtcacattcctttaaatttacactaggtaaattatatattttccaaatcttttataaaagcataagctaaatgagataacattaaaaggctgattggagatttccctttaaaagcagtcataagaacaacagcaataataatataacaacaatatacactacattttgggcaccatgctttgaatttatatacactaatattattaaggcaatctgtgcttttgagaagctactccagactaggcactacacaaactctgccacacacaagagagaaacaatttcaattacaaagagagctagaaaataaaatggataagagtatcatgaaagattttttgtaaaactgaatagatcctttcatgtttctcagttttaatctctccaaatatccctattgtctgctttttaaaagaaaaaacactgtaaaaattctgaaaaaattattcacaaagaaaacttccactcgtttatataaagcattattattaacttcataacatgcataatatcatctatttctgaaagaccattgaaaagtagccataaaaacttaaaaaattgaaaataatctttagagatcaacaggccaggaagagttctaagaatatgcattggcctttactaaccattttcaatgccatgcacttttgtctgtcaatactttctcctgttatttttaatatccctagattaagaaatattaacatctatttacaaaaaaatattctaacagtttcccccacaaaagcatattcccatgaagatcaagaaaacaaaaaacatagcagggagtcagtattctgacagccttttagtcttcttcatcttcttcctactattattattagacctactgcctattaccagtaggctttttaaaggtcttggacataaatatcagttgttaagttgctattttcatggtcatttaaaattatttcaaccataaatgcttttaatttcctgaatatcttaaagctgtctaagtataaatattctcccattatattcctctgtgctaacacaataatctagttggagtcaagtttcatgaaaataagaaaattggtacattataacattttaaacactgaaaaataaacgtgatagctgtaggatgtaaagtgtagtcaggcctgtagaacttcggatgcatcattttacaatatcatttatcattttgataaaactgaggtcaagtttctaaaaatacaacttgttaaaagcaggaataaatgaatgagagatgagtcagctcgtttgatggaaagggtttaaaaaatacttcaaaagcataccacatgacttggtaaatattcagtgtatcaaaatgtagttgccatctggcattgatagactgggctagaatatgtgtttaaaaagaacaagaaaggaaataactcagccaggttaatgtgcacttgtctacatttcataattcaggtattaagtgctttaataaatattcactatgaaagaaaggctgcattacaatcagacttgggcagtatttgttggggacagctagaaagaaatgaaagaagacaagacctgatggcacttaagaaagctaaaaacaacaataaaaaagtggtttaggtaaacagaattctcaatcatatgtaatattgccagaacactagtatcacagttaaatgcagggaagtggtaagcttatatttgaaaataaactgaaatcttgcttattttcagctttgaatattttaattattcttttctttggctttgacaatttaaaagtatagagaaatccagggaataagtaaaacccttggttggatagtaaaaaaaaaaaaaaaaaaaaaaggaaaaacgaaaaagtcctgacattctttgaagttttaaacctagagtttgatattaactttgcaatatgcaacaaaacaaaaagtaaatttgaaggactcctcttttctccctcttgctcaagaaataaaatatatttagaaagcagtatcattcacaaaagagaaaagtgaacacgagcagtgaacacttgcccaagcgttcgactgtccaaggctgtatctgggcttgttaattagatatttctgtctttaaccttgaacattctccagatttccaaatcttgacaatttacattctaccacatctcttggaatcagagcaataggcagaagagaaaagttttaaaacagctttgaaggttaattaggacagggaccagggtagccattaggaaaatagatgaagcacttcaggtgagagttgattagggtcaacatgaaatttttcagagttgaggtataatttatattcagcaaaattcatggacttcaaaatgtacacagaatgagttttgattttgataaatttatacacctatgtataaatatgtatatataaaaatgtatatatttaccaccataacagagacatagaaagttcctttgtgcccccttccagttaatttctatctcccataaacaaccagcattctgatttttatcacgatagaatagtttcgccttcacataacttatgtatactcttgtgtcctggctcttctgcataccatgtttctggaattcatctacattgttgtatcatactctgttttgttttatttgcttgttagtatttcattatatgaatataccacaatttgtatatccactttccacatttgggtgcttccagttttaggcaattacaaataaagtcagtataaacttgcctgtacaaatctttttgagggcattattttcattattttttggtaaataactaggaatgtaattaccaaacaatatggtaggcatatgcttaaccttagaagatactgatccaatgttccaaagtagaactatatatttacagaaagtcttgaaattaggtaatgtgagtctttcaactttattctttttctaagttttctgcaatctcatatacattttaaaataaatttgacaatttatcttaatgttagaaaaacaagatgttgatattttgatggtgattgcattgaatctacagataatttggggaaaaatgacactttagaaatactgagtattcatctataaataacggatttttctctaaggccttttaaaattttgagtggggaatcttacattcttttgttaaacttttatttaaatgtcttatatttataggctactgtaaattgattttaaaacttcattttcaaattatttgccggtactacataaatgcaatcaatttttgtatattgatcttgtgaccttcctaaatgcactgttagctctattagttgttttgtatatcccctaagagtttctaatgtaaacaatcatggtatttgtgaataaacacaatgttacttcttcctttcctatgcttatacctttaatttattttactcgtcttattgctctggctaggatctttagaacaacgctgaacagaagtagtaagaatatatatctttgccttctactatatcccaggaggaaagcattcagattttatcattaaggacggtattaattatatgttttcatagaggcccttcatcagattgaggaagtttcaatctgttctaattttctgagagttttcactgtgaatgactgtcaaattttttcaattgctttttctgcatctattgagatcatatttttcttctttattaggatgcatttacagtgatttattttcaaacgttaaactaaagttgcttttctgagataaatcctacttgatcatgaggtattatactttttactttttattgttgaagtttgtttgctaatattttgttaaagattattgtgcctagaaccatgaggaatattggcctatacttttattttcctgtaatatctgtcaggttttgctgttgggattatgcctgtctcataaatcaggaagtgttttgtttttacctcctatgttttctgaaagagtccgtgtaggattaatattatttcctccttaaatgttatatagaattctccagggaaactatctaaacctgaagttctttttttaggaatgcttttgacgacaaattcaatttctttaatcaataaaggaatattttgatttctttggtttactatgccagttttgttaatatgtttttaaataaatttacctattttatcaaagttgttgaaattattgacatgaagttttcataatattcccttgttatcctttaatattgttatgatatgtaatgataatctctcattactgatattcataatttgtatcatctcttttttcttgaacttttctgttatagcttataaattctgttaatcttttcaaatattcatgttttgctttcattaatcttctttgtagtttgtttttatttcacagttttctgcctttgttatttgttttctttttttactgcttttgggtttaaaatgattatactttcccactttcttaaagtggaaacctacgctattgatcttaaacctttcttcttccttctaatttaggattaaaagctcaaaatttctgctaagcttctctctggctcatattataaatgtcaatatattgtattttcatttaatcagtttcataaatttcaatatactgcataacttaatttaattattttaaaatttcatgactttcaaccatgaggtattaagtttgttgtgtagtttccaactggtcttttctagatattttattgttttctttttttatttctaatttaattaattataaacaagaagcatattttgtagtatctcaatcttttgaaaatgtttgaaactcatttgatgaaccagattagggtctactttaataaataaagtagaacatacatacaggactctattcctgtatgttttaaatatgttttaaagaacacatattctccaggtgggaatagaacacattctccaagtgggaatagtgttctgtaaacatcaaacaggtcaaggcagttgatggtgtttttaatttcttgtgtattcttactgattttctgcctatttgttctatcaagttctagaacaagaatgttaaaatctccaattgttattgtagattttactatttctctctagttttctgtcagtttgtgtctacatgtttatgacttatgcattcatgataatttcacacatatgattaggaaatatccctccttatctctaatagtactccttggcataaagtctattctttgtaatattaatattccaacctagctttctcatgcttattgtttgcattgtatatatctttctatcttttcactctcaagatatccatgttattacatttaaagtgtattcctgtagacagcatatgttgactcttgcctttttattcagcctaatactctctcttttaattgtagtatttataccatttacagtgaatggaattattgctacaattaagtttaggtctaccatttatttcattatatgcttttgatttttttcttttgggtttttgtcattgttattcttctgttttcctttcctttttttttttttttttttttgagacggagtctcgctttgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcctttccttttttaatgagttaaactgatcaattatttttccattcaattgcacaactggctttttagctgtaccttttttgttattttttagcagttgttctaaggattacaatatgcctctttaattatcactgtttacacagagttaatattttaccactttatgcaaatgtgagtatcttataagtataatttcatttactgccacccagtactttgtagtatttttacatacttcatatctgcaagtactatagactcatgagaaaatactataatttatgcattagtcagtttttcttttaaagaaattaaaagaataaaaggatattcttttacatgtaaatagatactttaaaatttttagtgaaaattttctgtaaaaacaagtttctatcttggttcatagtgtcatttcccttcaccctgaagcactcactgcctttcacactacttataggaattccactgacaacagaaaattcatttcttcattattgcaagatcacattgctctacataaaattctggttttgcagttgtttttcttttcaatcattaagaaatggcattacatttagtatgaggaatgagtcgatgtttgattattcccctgtaggtgatctattgtttccacccttagggctgcctttgagatttttctttgtatctttggtgtacagaagtttgaatacagtgcctacatgtgattttctttgcatatttttgtgttttttctcagcaaattttggacattttcagctatgatttcctcaaatatcatttctgtcccattttctcatctgccacccacaatctgctgttaagattctccaacaaatcattttttatttcagattctgtactttaacctttggttctttttagtaatttcatttcttttttcttcttctgagacatgcaaagtatagtggactggttgatattgttgtacagatcactctgcacatttttgaatcctttttctctctgttctttacattaataatttctattgacctgtattcaagtttactgacactttcttctgccatctacaatctattgttaagccacttcaatgactcttcaaaaaaatttcaggtattataccttaactttttacttatttttgaaaattttcatttctctgcttattttctcatctgttccctcattatgactatatatatacatatatttttagagacagggtctcactctgttgcccaggctagagtgcagtggagcaatctcggctcactgcaacctccacctcctgggttcaagctatctattctcatgcctcagccttctgagtagctgggattataagcatacgccaccacatctggtggattataggcgtgagctaccgcaccgggcctgaaaacatatttttttaaaatcctgaatatatttataatttctgctttaaagtccttgtctacaacttctgaatcatcgaggaatctatttccatggactttaaaaaaaaattacatgtcacatttttctgtatccatcactggtaatttttgaattacagttgaacattgtgcatgatatttatacaaactctgggtttggttatctttctctaatgcaatgcatttttcttctagcaggttattaaattactagtcgaccactttgatttgaagaggactggttttattatttgacagaaactttcaatgcttcaggtttgtctctctttctataattaatttcttagttcttagctatcatctatatttctaaggtttgatccttctgggattcataaagcctgagacatttaccaaacccttctaactttgtaaactcaaactcctaactttgtctcctcttcatctaatgtatctgttcagctcttttagctttctagttgttgcttttctccaggcacttataggctcccacatacatgcacagtttatatcagccagaatgttagggtaacttatatgtagattcatgggagccttccctcgatggctccatcctttctaatacttccttcctcaatttcagctactttgccaatgccagctccattcgctaacatcacaaaccaataagattgtggttttctgcctgaattctaacttctctataccatacagactgggaagttccttgagggaagaagctgtaacaaacgtgaattttacccgggacagttcactccagattccaactgcttttggtcactctccggtgccttcaaataattgtggtgttttttttttaagtttttaattggagtttagttttatttttaacccataccatggtttggaactgttatctgtggaaatatttgtcctgaaacagtacaagttactcctttattaccaaaatcacaactaccaaaattgtggttttatgttagatagcacttgaactgatatggaaaactgcattagaatcaaagtgtctatagggcttcctctctcaatattcagtattttaaaattgagacaagactattttttaaccttaaaaaaatcactcatagtgccctaggaaagtgctatatattccactcagtcgctaaatatggccaatgaatatttctataattaaatttagcagaataatctgtgaataaaatgaaacagacctgtatgtaaagaaaactaccttaatgaacttgcttgggagatcagtggtatgtgatatttctaatcatgacagagaagttgaacatgtggtacagttgtgtagggaaaatggataactcttatcttcattattttttaagtcattctaagagaagcatttgctaagtagtttatatatatgaacttatataattttcataacaatttttaaaaatagtattgtaacattattttgtagatcacaaaactacaaagtatcccaggccatcagactccagagttaaattccaaccattccctctaactacctgctcagaattgagataaaactcatccacagcagtcatcattttttctaagaatatacatcacctattaatgttctttcccatctcccatgttaacaactttcttcctctatcatgtaaacttgctctctatcatctccgtgcctttcttgttcattttcatggagcagccataaaatggagaataacaattgaagcagtgaatagccaagaagcatctctcaatcaatgaacctgagacagcctgttcacttctgtccatcattcttgtcctttagatctcagtttcaaattcatttcttctagacattcatctcttcccatgtttaatctggaaccatctacccttccaccagaccaattatcctggcaaattaatgtaatagaccagtattaattatttgcttgtatgtcttaacaacattctaggtgctgtgccaaaaacaaatgaatagcaacacaaggtcttctggttacaagcacattacattttggttggggagattttgacccatctcacagtcataatcttcatccaggttatctcgtcaacctctatgtatgcatatattccaatattttgttttgcttttctttcttccttgtagtaatttcacacagactattcgcttcaagaacctaactaacttcctgttggtacccaatcctttaactctagagggtcaaatggagccctgtggctcctggcagtgttcctgaagatcaggtccctctggtggaactcagttctcactgccttatctaaccttcctcactcagcttgtaatcaacttaacttttaaagtctttgtacacattaggtaatatttgttctctgaactcccagaggggctgtggtaactgcccaactaggaagccctacccttcattattcagcaacagcttgaagaatattctaattctaactttccgccctctgacagaccagctgcatcaaaggctgtgttcccctgtttgtttttttcctgaagcagagtcaccatttcaaactaagtaatctatgagaaaagtaagagctctgggtccaaatgtttaaaacatggctcttctgtgaaccacggcaaatctaaactggattatgccttatgctggagtcagaacttacttggtcccttgttctttgccctctggctccctgcatgctgttcaggggaagttactggcttttgaactggcggtttgaaaacgaaggcatttttcttttagggagaacagtctttcagtgatttaaacaacaagccttgtgatcaaaataattcataaaggaaaagatttatgaagtgacttcactagcacacaatgcattttaaaaactttgttttttaaataaatctgtcagtacagaagccaagacaacacatctgaatgcaatatcagtggacacaccctgaatctcttcttctttgcttgtccaagactgtggtagaaaagggaaatgattctctttgtcttttcttatttaatattattattaaaaattttttaaaaattctagttccatgaaaagactttgaaaaattgtgcctacttttgtttcctgcaggaaaacctgccttgtaaaaatgtattttccattgaccacttgtgcttgtttaagaaaataaaaaataaataaagaactccaacttataatgaatacctctggcattagggagcctgttctaatctccctttatcaagtttgagtgatagttctgctcaacgagtattgacagggccgtcctgtttctcaggctttcgtttccctcggttggagaaggatacagtgcattttcacattctcaaagtctgcagttgtttttatataagaagcaatttgcttgggtcacgtcaggtcgaatgggatgcctgcccagctcttggttttaaaggaaaaacatacagaaagacacaaaaacacagcagtttccttcattaaattccactctacctgccatgggcttctagccacaatggaatttcccaccctggcctagcctagcctaacttttatttttagggattttttttcccctttaaatcttatgagctttctttcaagtgaactttgaggtaaggattattaaatgatagagtaattgcctggttaaaaaagaatcagacataaaaaacaaatgcctagtgaccttccataatatcgctggataaccaccccctggataacagcctttcaaaaactgttcataatcagcacaacaagacaggtcatgtaatttaaaattaaaacctgaatcatttaatgaatagggatcagcatttttttcaatagtaccctcttcttacctaattgcattggatgaagataattttggagaagaaaatgaataaatgaaaacacaaggaactagataaatagatggggcgggtggatggggggtggagagagagacagcaagtgagagagagaagcttttggacctctctctccaaaaagccatttatgcttttccccattgcctaggggcaactgatttaatcaggattgttcatgtggattatctaaactatgaaaagcaacagggagcacttcccaagaaatccagactgggtgtgctgcagaatacttggtttggggcctggagctaagtagactgttcacattgtactcagggtcctaagaaaagtggctcagtgtctctgtaattctttgtccctttgatctacctcaacatttggtgtctcttggcattaggaaagctcacgaaaatgaccctgcctagttaacagattcatagtctgggcacacaaaaaaagggtaagaaagaaaaaaagctttggtaatgagggagagaaacgtaccttcttgctatctttgctgggcataaataaaaatcgaaagatgtgatttttggagatgtgaatcccgttcttcccatatttagtaatagccttttcagagccaattcaagaccttctatcaaccacctctgttaaacatatcaagttagatttctcattcattattttcaagctggattttgcataatcttccttcaaatgaagaagtttacttttcgaacatgtcatttgctcttagcactgttgttctccttcacccattttggcttcttatcctcaaatccctgattccttattaaagtggattgttaatgcagccattctttagcaccacagcacatttataaatcaaaaattagtttactctgcctggcttccaaaaccatttgctgcttgaaaccatttcatgagtttgtctactcatgtgaataaataaaaacttgcctataatgtgactttgggaaaggaaagagcaactatatgaaacgaattctacagaggccaaaattattttcacgagtttcatggattcagcccttgcatgtgccattctacattaactttatctctgagattaggattttgcttctctttttttttttaattatactttaagttttaggctacatgtgcacattgtgcaggttagttacatatgtatacatgtgccatgctggtgcactgcacccactaactcgtcatctagccttaggtatatctcccaatgctatccctcccccctccccccaccccaccacagtccccagagtgtggtattccccttcatgtgtccatgtgatctcattgttcaattcccacctatgagtgagaatatacggtgtttggttttttgttcttgcgatagtttactgagaatgatgatttccaatttcatccatgtccctacaaaggatacgaactcatcattttttatggctgcatagtattccatggtgtatatatgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactcacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccatgagtaggttgtgaaaattttctcccatgttgtaggttgcctgttcactctgatggtagtttcttttgctgtgcagaagctctttagtttaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactatgcttcataagtgaaggagaaataaaatactttacagacaagcaaatgctgagagattttgtcaccaccaagcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaatccacacataacaatattaactttaaatgtaaatggactaaattctccaattaaaagacacagactggcaagttggataaagagtcaagacccatcagtgtgctatattcaggaaacccatctcacgtgcagagacacacataggctcaaaataaaaggatggaggaagatctaccaagcaaatggaaaactaaaaaaggcaggggttgcaatcctagtctctgataaaacagactttaaaccaacaaagatcaaaagagataaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacaggattttgcttcttaagtagatgtcatttttctccagtaaaaccaagtggtttaccctgacatttagtagtaatttagtgatttcagagttccttctaaatctaaagtaaatgttcatgagactcatgaacttgtatctagacaattaatctgagcattttaagacttccctgaggctacatataatctctcacaaccccttgcaaaacctgagattttgaaccactgtcaagtttgtggttgccctggtaaggagtaaagcaaaatcattacttatggcaactaccacacaaacattgtagtgaactgaagtataagaaaatcactactatactttagacagaacattaggattaatgctggtaaccaaggaactaagagcctgtaaatataactggcttaagaaggagaacaggattaaacaatattggagtttagaaacaaaagtagtactgtatcaacctgtcactatgcagccagtcattacaataaaactaaccaaaggatggcggcagaaagaaataaaagtatttttgtgtacaattcttcttgaagcactacttgaattgcatctgtagggaacaggtctcataggtctattatttgcccacctccccaacacacacacacacacacacacacgtactagcctaggccgatatctactgtggtaagtttgcatctgtgagccactgagcagctgctttatatatgcagcataggatgaaagagagaaaactggggtactcatggtttttgtgtaatatcacaaagaaaagaaaacaaaaaaaggcttagagaaagttaaaggaaaatgggcagtggtacatatacagaacaagttaggattccctaggaactggtaataggactaaacttgcttaacatctatcaaaatgacttacttattccagggtcttgcatatacatagcagaagcacaattaatttttgctgaatgaataatctggaacaaggaatgtaaaataaattatccaaaaatgttgatggaatgaaacttttctgagcaaggaaaagctaaactgatggaacacaatatttatccaggtgtgcagaaaggtgccagtgcaaatagagaaaaacaaaatattcaaatacagtcgtttgccgtgtaatgacattttggtcaacaatgaaccacatatatctataccatggtggtcccatagattataatactgtatttttgctgtaccttttctatgtttagatatgtttacatatgtaaatacttaccatctactctgttacaattgcctacagtattcagttcagtaacatactgtacaggtttataaggtttatggcctaggagcaataagttatactatatagcctatatgttagtagtatataccatctaggtttgtttaagtacactctatgatgtttccacaatgatgaaattgcctaaggatgcatttctcagattgtatccccatcatcaagtgatgcatgtctagtttaattataagtcttacctaggaaagggacttaaaggctatgagctctttcaggcaaaaaggccttcaaaattttggcactcattaagtaaagtaatgaaaataaggtttataattcccttatattaaaccctctgcaattatgtgaaactatctgtacttcaaatgccatgttcctataacataacaactcagggtgtcttacacaggacagtcattaaagagtttaaggtagattaaaataatctgcattagtagagaacaaattattttgcggtattataacaattcattgaacatgagaaaaagcaaacaaacacgcttgttaataaatgttacttaacagacatcacactgacatttcttagtgactgactgccatggaagctttctaataagtctaatttttcccacgctctgagtttataagatagcaatattgtagctttgggtgtttacctttgtttatttattgggcggagttttattgcgtgcctcctccagctgtgccaatctggtaagatcaaatggaatcctttagctattgtcactatcctaaatggaccgcatgcttcctttgtcccttgcattctctgattttcgctgggggttatctatcatggctgtacatccaagtctctaatctatctcctttctcatccgtttttcctgacttatttcccttttccctttgtctatttccctgtgagaagccaaaagactgtatagttcttagtagcggtagtagtgctatctagagttggcatccaacagcaccagtgttataatacactttctacaatcaagaaatgatttgatttccttgcctcagtagaaattttacaagttaacagtggttcacctgatataaaccataatatttctatcatatcatgaaagaattctaaaaaatctgttagactttcttctacaagtttgcctatttcctctgaatacagttaattcacctggcaacaaaggagattagctatttctttttgtatgcagacagaaagaagtgtgatctttctttgccaataaaaacttctagtaagtggtgatagacttcaaaacccttctttttatttgaaaatcatggttcagttatcaggaattccaaattcagaatctaagaacagtgatcctatatagtcttgtgattttgcacatgctagggattggtaagttgctgaagacttcttaaataagagaggaagcatttttcttttcacttgcaaagaaccaggaggtacattaaaagaggttttagagtaactagaatgtgtgataaactgttcactttctgttttaaaactgtccatgaggttccctttagagataggacagactacagagaacgtggtgtctcgtttctatgggttgaaattccacagaacaatgctttgcaaagagtcataccaccagttccttttcctgtgagatgcaaatactaaaaacagatatgggctggacaagattattttaaaaatagatagaaggcaataaaagctttggtgatattctagattacatatgaaatgtgtaaaagcgtaaaatgaaaagttctctactttttaaaagctgcatcaaaatttccttcctacactgtaatcgtgccccttaacccatctatgcctgaggttgcaatttctttgaatttctgcaatcagaccatggcgatgaccttgagcagtaggatataaataactcctccatgcttagcgttccaataatggaacactaggcataaatgggataaaacacaaattgctaggttcatgataaacagagcacatctgtaaacaaaataacttttaaaaaatatgcctacatatataattttattacttctagaaacacaagtgttattagacttaaagagagccagtgaattgaatcaacttattctgatatgaacctcaatgtgatctgattgcaggctgcaatgattaacacgttttaaaagaaatgggtccatactatactttccaactgcccacccttctgttcttcttatgctacagatttatggcagcctaacctccagccaacaagttagagaattgggtaagacatcattttggctttttaagaaaattatggataatcaaaaaacatgacacaaaagatttagtggctattatcagggtataaactaataactaaaggcatttatgtgttaggtaataatgatgcttagaaaattataaatatcaagatgctctttcaacaactatattccagatttaggaattttgtagaggatatggcataagagtgttaagaaatgtatacttttttgaaaataaaataaagtctgatttatttattatccaagttcctgtgttttctgggaaaaatgtattaatgagaggtagcattatttgatagttaatggagagtggaaatcatctgttacaggcccacatgctcacaagcaaaataatattctctcaatcctcaaatggaaatggggattataaaatgctataagactctgtcaacatttctgataaattccatgaaaattttgtgttacatattttaaaaattgtgtactatgattataacatagttgattattaaatatgtaatcctttctttcagattattcttcttccttaaatgtaaagggtatattattttcttgatttattcttttggataaatatcctgtacatagatgtctgaaatccagcccgtcagtttccctttaaattctagcatattttaaaggaccttaaaagatgactgtggagtactgcctgatttggaacttgcctctgtctcttacacactgtatgacgttgggcaagccacttaacttctcagtacttcagtttcatcatcagtcagaacagcacaataatagtaccctgctcctatggttactatgaggattagtgggtttcatactgtcaataataagttgcctttctgggtctttgaagtacttgaaatcaggttaattaaattaagcagagctttggtccctttgtttgacaagtaatctccaattttcatttccaggttctgatcccctaaaatcagtggaataaaaccttgtttgtgtaactgccatcttcctgccccaaagccaagattaatttacctgttggttttagttttcactaggtctctctttagctaggtgcttctaagggtaaaatatcaactattaaactatttgaggcaggagatgttgaaaggggaatttaattgttaagtcaatagcagtgtgccagcttagtctgcctttcagaaagatcaccatagtaataacgagaccaataaataaataaaaagtataaaatatacatctatgcagaatcttagaaccctttctctaacacataagtcattaaaggaagctctgaggtctgcctatgtgattcaacatttacacacatcatagttctatggaagaaattctcagttgagagctaccagctttcttcagatcggatcagatttttctatactccattataaacaacaaaaacaaaagcaaacaagtgaacaacaacaacaaaactgtagttgtggttcactccagtaatatatactaccaattcagtggttcttaactgggggacaattttgccacccccttccccaccaggggagaactggcaacatctggagacaattttgataatccaaactgaggggtgctccaatggggagaggtcagaaataccactaaacatcctacagtgcacagaacagacatctaccctgcatcccggcaaagaattatctactccaaagtatcatagtgccactgttgaaaaaccctgtgctaaactaacatctgagagccactggccttaaaccatcagccacatcaacacgtaagacactcagcctatgggatagtctaacagttaaagaagacaccttagagggaactacttcaaaaatatataaactgacaaatctggataccatactaaggaaaaaactggtaaaacaggtagttgtttgaaagcttcttatgcccattattataaaccaataattttagattactgaaccaaccagactaatattccctttgaattccaggaggtataaaaatatgaagtcatcgactatgcaacattatcctgctatggagacattctgaaatggtttataaaagcagtgaacacattaaaaaaaaaaaaactagcccaaatgagttatgcaaagttaaagtcattttttctaggaccagttttttttcctgtgcatagtattttccatatgtaccgcaaacattcatttgtgcagaacatagcaccacatttctaatacaactcctctctgaagacaaatcaggctaaagctaagagttgcagaaccatttctgtatgagtcatttttagcacaacataagccctagagtaaaatttattttctaaataagccacaattattctgcaaacatttaacctagcacctctcaactgttaaagaatgtcaattatatatgaaaggaagaacaaatataaaggaaatttgaaaatcaagaaaattttttctgagaaaagtttgtgagaattattatgaatacagctaaaattcaaatatgtgacattttatttttttaagggtttccctgtcaaagacaacacatatttttctaatgaaagaggatgcctgaagttgacattcataagagcatttggatactaccaatgtgaagttgtacagatttactcatttctgcaattaccctcttgtgtttgaattctactttggttagtggtagcaagcactaaactgtactgagggcttcgcaaaagttgactttatttctttacacttagaaccccaaaaatttacttcctaggaagatactagggaatcatatcttactgaggaggaaataagaggtggaataactggattagcctcacaaagaatgaaagctcagtaatttctgagttggcaatatttttcaccctccttttctccatttaaatttctagatttaccttcaaaacacttgcctttttctaccttaagggaagttctaggatcagggagatggagatagagaaggtagagatagttttaggttttcacagaagttcaattaaaaactgccaagtacctcctaccaagagaccaccactaaaatttatttctagaacaaggtgcagaaaaataaaaggtagaaagcaggaatgttctggtactgtaaaatatttggggaaaaagtctaatttctgttctcaaaatggttactatcttgctctagagaaaaacataaaccctcttaaaataactgaagaacaataagaaacagtataattaagtgtaaaaatgggtggtagaagcaaaatgctgtggggcacccatgtgtcttacatctttccaacacagagaaaagagacaatgggtcaaatgcagcctactctagtctctgatattagtttcattacacagctataatcccattacaaagaacttgaaggaactgttgacattttttgctgccctggagtttattgtctcaagtattgcttgaaataccagggtacatgcagagatgtctgctctaatggtatttgttgacctacattatgttagggttagcctgaataaatggagaggaacgctacatggaatcagttagttagattgtttgtaagtaggcgtgcattatttttaccatgttttattatttttaacctaaagactacgcatttaaagtagggtattatctgtaagtaatcttgttgttatatgaaacagtaatatttattaaaagtgcttttgtaaagcccaaaaaggggatctgcagaggcagatttactgcatatttaatggagcttaaacctcagggaccttcacttgcgcagccccccttccaaggtcctgtacttaactctgtaatcataattttgtattctttttcttcaagaggaccccccaaatagtttaagcttctggtaaaatcttgatctagcctaggtataaaataatcttgaagggatccaaactgatagttctaaaaggctgatgctgagaaagatacaaaatgtgcttttacaaggatatcatatcaattatattttccaaatgtatctctcttattgttgtcgctcccccttccctgccaataaataaatgccattttttttttttacctcactgttaaaaggttattagacccttttaaataagatcggtctgttcagtgactgggaataaccagagtgttaaaaaaaagatgaaaaattcagaggcagaagataatttccaagaatgaaaagatatcttagagagactcacaaaatgtttcactaaaacagcaataattattatccatacctaaggagtacatgcatttgagaaaaggaagggcatggaaagtctctcaatacaatttacagtagtacctactgaaaactgtgctgagtttacacagagtgtgggaatttttaccaccagtaacaccacgtgtctgtttttctggtttctgaaaaccccaaataaatcccacaagcgcctctaaactccaccatggaattctcacacttctgagtaagaagttcagaacagaataaaaactttggatgcagtatgtctgtctatagtttttcctataatgccttgtcccagtttttgaagaaaactgaataaaaattaattcaagaaaaaaaatgaatgaaattacctcaaatggaatattaaattgaaaaataatagtcaaattgctcataaccacttcctgttaattttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgacttattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacagaaaggaaaataaagggctatagaaatcttaatgggcaagctccagatgctcaaaagcaattgtttagttactctacttagttatgcatcattcaaaacactttctaacaatcgggcaagaaaggttcctttgtgaagaacaggctttggggtcttggacaagttttaattctagttgttttatagctcatacaaaatagttgtggtgcatatgtaaagaggtactgtacttacatgcaataaagtttgcagatgaatattttgaaaatcaaagaaaagaaaacaaggggaggaatgagcatgtggtaccttgctctatttttaattattaacttgtagcctcaaagatttccatttagtagaaacacatgtaaactacaatgaaggagtactagaaaataaagtcaattggtataactcaaattattttgtaaaatgtgaaattaagctttaacctgtctatgtggaagggtgatgaataaatgaatgaatgaagtaaaaaatcaaagatacagagttgtaactgattttctttgcatgaagtagtaaatattaatattagaaatatcttttgatttagataaaactggccttgggtatataatacacaacactgaaaaacatttcaaatgtggtatttgtttaaatatatacatacataaacacacacatacacacacaagtcaaaaatatgggtgttctggtatagttttctgccttcaaagggtctctggaaaaaacagaagaaaaggtatcctataaactgcttttgctgaggtctctagtagagagcaaatcgaggcaagtgctgcccaaaataatctctattacaaacatttaaaaaatctatctttcatatatatatatgaatatatattatatatattatatatatacacaatatttttaatttttaattttattttatttgctgtatagctaacagcatagccaatgccctgatcttctagccacactgtaatttcttgtccttgcatcacaaccccagctgtagtcatcaaagtggaaaaactgacagcattgtctgaaagacacagcttgggaaaattgctccttgtagctcccctgtcaatgaatattatcatatttttctcatggataaggttactgtgttttttttgctgggccgggggtggggaggcttctacatacttagctactaagcacattaccattccgtttgtggaatggactaaacgtgacaatgcgagctgtagggttagcattcccaacattctgttttaaagtttttgtgtgtatatcttcaaaaataatattcctttatgtattcagaagaagtaaaatcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttagatatactagatgccattgtaatcacatgtattaactcgctaaatcttcacaactctaccagagagtactgttattactccgattttattggtgaggaaatagaggcacagagagatcagaaacttgcccaagatcacacagtcagtaagtagaggagtcaggattcaaacctaggaagccagactctgttacaggatgaatattttggttgctaaaggccccatcttccttacttctcctgatcctcttccccaactgatcagcttgcagcattcatttgatcttctcaacaaattacgtattcatttgcacaccgtccatttagaataacacagtagttaaaaacttaggctctggagtctaatatgagggtttactgccacatattggtagtgcttaacttttctgtgcctcagtttccttctgtataaagtagtaataataaaagcaatttcatgtatttgttgtgagggttaaatgagataatgtatgttggagctcaatggaaggtcaatgttctataaacattaagttcattattattgatttttatctcttaataaatagaatccctttttccaattagattgtttttcagaaaaattgtgaatatgaatcttttttgtctcgtgtaggggttcccaaatgttcagtatgttgaactcttagatgtcctaggtactactgaaatcacgtgtattaacattcataacaactctgtcaggtaatacttacatttacccataatattataaatgatataatataccaatgtctaaaatttagtgagaacttactcactggacaagtgcattatggcattatctcattctccctctaagcctctgaactaggggatttttttttttttttttttttggagatggagtgtcactctgtcgccaggctggagtgcagtggcacgatctgggctcactgcaatgtccgactccctggttcaagcgattctcctgcctcagcctcctgagtagctgggattacaggtgtgcaacaccacgcccagctaatttttgtatctttagtagagacggggtttcaccctgttggccaggatggtcttgatctcctgacctcgtgatgcctgcctcggcctcccaaagtgctgggattacaggtgtgagccactgtgcccagccaactaggggatttttataatctcaagtttatgcaggaggaaacagaagctcacctcggtcatcagctggtaaatgttcacaaatgtaaattcttaaccacaatgccatactacctgctaaaaaatgaatttaaggtagatctttagtaaatatatttggtcttgatgatgaatcaattgaattctttatttctgttaccagaaaccttgcacttaacaataaactaatgtggccttgaccagcagccgccagtccccaggcttcagacactggtacctgttaggaacttagctgtacgggaggagatgaacagtggacaagcaagcattactgcctgagctctgcctactgtcagatcagcagcagcattagattctcattggagcacaaaccctactgtgaactgtgtatgcgagggattgagtctgcacactccttatgagaatctaatgcctgatgatctgaggtggaacagtttcatcctgaaaccatccccacacctccagtccatggaaacattgtcttccatgaaactggtccctggtggcaaaaacgttggtggctgctggcccagacaatatcactcattctgttaactattgaaaagagatgactgtatgtcaggtacatgccaaatactggaaatttgaaaaatatatatatatacattgtgggtctaaaactgtatcattaaaagcagctaatgatttaatatcatttcatttactatcattttctgtttactcttacaaaaatcaaacttcttcctctccccttcctctctctgcctactctttcttattccttcttttaaatcaaagttttacagtattaaccttacaaagatttttgcccataagaaggttatatgttaaggcaaggaactgttttaattatatttactcttcattttgagtatatttctttttcatacctgacaaagacttttgaaatgactaaagaaaggcaaagcaatctgattctttataaaaaaatctttcatatgcaatcttttgtctgtagtattctcataatagcttagaaattttaaaagaaggttttagctggttttgttcttttcaaattggcagaatttgatttttttcctcttcacatttggattcactttaaaaatcaacaaacaagaaaataaaaacatattcaatttaaaaaatatgctctccattggtgccttggcatcatcaaccaatatcagcatcactctgaaaaccatttctattctgtttttaaaaaaaagagttttaaaatgcacacataaaatgcacttaaaattgatcctactgtattaaggagagagaaaatttaagggcaatggagagctttgctgtaaccaactcttcagtcaactataggatattgttaatactgccttcacctccacactgaagatataggtaccattttgactgtgcttttgaacaatatatagctaaagatttgaagtgagtaacttcaaagtcagtagttttcatgtatacgtcgcagaatcactgcatcttatgtatgactttaagttgtattaagctgataatttcaaaaagagagactttcaatgaaagaaaattcctgaaatttggtcattaaatggttcgagtacgtagaattacttacaatgtaatgccaaagaaaggtatattgtatttatccagaaagcacgagcataagaatgacctcagaaagttattataatttattacttcattaaagatacatttctagtccatctattatgtgctaggccttataatagacaacaaaaatgcaaagaacaacaaatgtgatctgaaaagtagtaaaggttagggaagatgggactagtaagagagaacagaagtaagaaaataaagtgattataattgtaactgccatgagctgagggcatatcatgcattgaggtaaggtcctaggtgcttaatatgaacaagccctgcaagacaggtatcataatctttgtctcacaggtggtgttgggaaaactggctagtcatatgcagaaaaatgaaactggaccccttccttacaccttatacaaaaattaattcaagatggattaaagacttaaatgtaagacctaaaaccataaaaaccctagaagaaaacctaggcaataccattcaggacacaggcatgggcaaagacttcatgactaaaacaccaaaggcaatggcaacaaaaacccaaaattgacaaatgggatctaattaaactaaagagctcctgcacagcaaaagaaactatcatcagagtaaacaggcaacctacaaaatgggagaaaatgtttgccatctatccatgtgacaaagggctaatatctagaatctacaaggaacttaaacaaatttacaagaataaaacaaataaccccatcaaaaagtgggcaaagatatgaacagacacgtctcaaaagaagataattatgcggccaaaaaacatatgaaaaaaacctcatcatcactggtcaatagagaaatgcaaatcaaaatcacaataagatactatctcacgccagttagaatggcaatcattaaaaagtcaggaaacaacagatgctggaaaggatggggagaaataggaatgcttttacactgtttgtgggaatgtaaatatagttcaatgattgtggaagatagtgtggtgattcctcaaggatctagaatcagaaataccatttgacccagcaatcccattactgggtatatacccaaaaaaattataaatcattctactataaagactcatgcacacatatgtttattgcagcactattcacaatgtcaaaaacttggaaccgacccaaatgcccatcaatgattgactggataaagaaaatgtagcacatatacacatggaatactatgcagccataaaaaaggatgacatcatgtcccttgcagggacatggatgaagctggaaaccatcattctcagcaaactaacacaggaacagaaaaccaaacaccacatgttctcactcatacatgggagctgaacaatgagaatacatgaacacagcgaggggaacattacacaccagggcctatctgggggtctacggctaggggagggatagcattaggacaaatacctaatgtagatgttgggttgatgggtgcagcaaaccaccatggcatgtgtatacctatgtaataaacctgtatattctgcacatgtaccccagaacttaaagtataacttaaaagtttttttaaaaaatatgtgataaaataaaaaaaagaattaaccacagtgccttgcctattcttctataacagtatctatttcactctattttattttgaagctatttatctccaagtttctttctagaatctaaacagttaacagcctgagggcattgaccttgactcttgtctaagttttacaaacaaacaaaccaaaaagcacactgcattgatatacttggccaagtaatgatgtccaaatgctacaatgtcacaaccagtgctcagtaactattagataaataagatagagtcattcactcaatcattcactcctgcatgtttcacttagtaatcttgtacgctcattgaataaattaaaagctgctttatgaaaatgttttctgttaatttgaataaaaacctttacacatcaactagatacaaaagagaaatctattgtttgacaatgatcgttactgaatcaaaaaacagtggggccatctgcagggtacagatcatgctagagtcagggaaaactggtgataaacttcagaaagccaagaaatataccagcttacaacttagcagcactgcctccacacagtcttcaggtatttattgactgtctcacactaatgcatgagtgcctgtggtaatggtaaaagtatataaatttacttgcccagagatactaattgttaaaacaaatacaacaatttaatggcaatgcaagagaagacagactaacatttacaaagctatttcttgtttaggcaagatagtagactctaaacatatattatctcatttaaattatcatttaaaaacccttagattgttagtatttacccattttaattaaaaacataactgagcgtataatttttttttttttttttttgagacggagtctcactccgtaacccagattgcagtgcagtggtgcgatcttggctcactgcaacctccgtctcccgggtttaagcgatccttctgccttagcctccaaagtagctgggactattaggcgtgtgccaccacgcccggttaatttttgtattgttagtagagttggggttttgccatgttggctaggctggtctcaaactcctgacttcaggtgatccacctcccttggcctcccaaagtgctgggattacaggcgtgagccaccacgcccagcctgtaaatcttgacaaaattcccagaggcaaaattattagaaggctgggagccaggattaaaaaacataaaatccttggcttttccatttatttcacattgcctcttcttagaatccacttctacaccaaagcagttaaaatcaatgtggatttgtattttaatagagggtttatggagtagtgggaaagatagcaaataataactatgtttattgaatactactgttcctaacattttgaacctatccaatcatttaatcctacaacaatcttttggaagtgagtgctattattattattgccactttgtaacagagaaactaagccaaaaagaagataaacatttgaaaagtcataaagctagttagccgctgtgcagctgaacttgacagcctatagcccacagagtttaaccatcatgctatattgcttcattaggttgaaaggttattaaatgaaatggcttaaacaaagttctaagcacatggcatggcacagagtaggtcttcattaaatgttagtttctgttttttctttaatctctaaaattctataataataatacctttattttcaaagtaattctgctttttaaagactttatgacatctgatttaaatttcacaaaaaaaggatggtgaatgtggaataaatcttcacaaaaatgacactgaagattatttaaaggcatagaatgttactcacaacacagatttaagagacaaaagtagaaacagtgttcacagtgttttaccaaaaacaaaaagggtatatatgcacaggaaaaaaaatgattagaaaggtatatccccaaagtttgaaaacaaattacttctagacgattgtggggattttaatcgtcctcttgtaatttatgctacgcacagaattctacaatgccttttgtatgctttctatactaagaaaaaataaaaaagaagagtagtactccttttttgagatcataatactgaggggggagaaaatcagtagaaatgtgtgagatttcaccctcagtgatagagctggaatagaattcgcactcttcatctctaacctactgtgttttatctgacccttattttctattcagtgcttaccataattgatgaattcaaaactaatctatgatgaaaacccctgaaagtgattagagagactgtgattgtaaatgtggtatcaatcactaacacaaaagtcccttataactcatcaggcttcttaagttgtttattcaaaccatttgtttctgagtccaaaccaataatatatgtgatagaccggattactttctctaattcttcactccctctctataatagaactttacatccataaactttaccatatgacttgaatgtaactctcagtagagtatgtgttaatgtgggagatgggatatatatctctgtctcttggctttgagcttggttaagtgacttgctttgactaatgaaatattagtaaacatgaaatgagcagagactttaggtattttctgcgggaacaaattctgtagttgtcaatagtttattctcctagattaaatgtttgataaacttttctaaaagaaggaatttttttttcagagagaaatatagctaacatggaatatcatgtccttttgtacttacctggagccaaagtaaactacttggaaaattaaggtaccttttgctggactattcctcatcctttagtttcttcagtccagactgggacattttggttaaaaaggagtaggcttgtgatgttaaggtgatcatcttggtcaccataccccagaaaaaatctttacatatccatgtcttagacactgaggtacagaaagagagttctgaactttccattccattgtcatttgtgttgtggagtcttattaatctgtctcatggaaggtgggaatcaggctatgaatggacaataattcatggggggcagtcaacagtagagaagaagttgctgcaaattgattaatacaaacaaaccaacctgagtacctggctcattttaggttccctccaaaggcttcagtacaggcagtaacttagaaggtaatctcagagggtaagataataataaggattgacaataataaggattggccaggatctctgagatttacacaaaatggctccagaggtagacattataaagaaatagaggctagaacatctctttttccagctctattcctcctttagttgagagtttccccagggcattaagccctgggggcttaatgtaagccccactctccccatcctagattttttgagatctcccagcattggaaaaggtcctggggcagaaggaaaagcatacttgaggtgggagtctgggttagcagagaacggcttcaggtgcagctgaagggaccatgacagcactgcctgacatctctgagggactatgacaggattctgacagccatatctgctacagaagcctgtaaagacttggggtggggggcagtggtgtataatatactgtgtagtctgatattgcatcctttaaagtatgatctggggaaggttaggctgcatcttctttattaaattatattccaaacaagttgtctcctctgactcctgcatgaagtcagactttgggacagtaaatcctacactgtccagctaagaaaaatgacatgttgttaataggcttaactgattctcttgctatgatggcaagatcagatttttagcagtgcttctgaaaatcctgacactcattcaccaattattttcttctaggagtctaatatgtattcatcttcccatatttcagggaagaaatagttgaacgactttagggagcttttcccaaaatgctgacgcatttttgcagcattttgccataatggggcctattgaaaatttttctgacattctgaattcatagcattaagatttgtggtgttgtttttgtatctggtttgtatttatttttgtttttattaaaatacaggagaaattgggacaggttaagagttgcacctaaatgtatgaagcttgaggtctttgaacataaatgagttagatatacagaaagttattaagacctttaagcattcgtaaacatttcatcattgctgacaatatctatttactttaggtaaccctgcctgagcagctcctgcattgctacaaggatgaaggtggggttatttaaaaatttaccaagctgtgaaagagttttctggagaaaactggtttggggactcagagcataaggataaacaatggatacttttatggttacaggagaggagttgataaacccctcattcctctaatgtaatgtataaaagaaaatattgtattcctggtcctcacaaatggggaggtggtagggtaggtaggttatatgaacacacatgtcttccctttgacaatgagtgggcaggcctttaaaaaaaagtctgaaaaaataaagagccctggggaccatttaggctctatcagtgagttctatcctgagatatcaaatccagttgcacagaatctaaatgtcaatatttacaaagctctttccatcttatatcccgcttcctttttcttttatgctctttctaccccttttccttcctccctattcccttgatcccctacatcattctgttttcccatttgctctcatttcctaacaacccccatccccattagtcagtccaaaatctgttcatcccgctataggcttcagtgatggaaaagaaagggccccaaacaaagccaccatccaagacaaggagctccagagggtggtgaattggtgattgaggtaaagcctggggactgagaatgttcaccgctctggaggttcttagcccgaaaagtgattaggcatcagcaggcttgatagctgtatcaagcctcatgatttcaaagctttcatgagctgacaaggacttgctaatttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtaggaacgctgtcttgcattcattcagtccattaatttctgatggtgttaattaaaaacttttgatgctggtttgaatggaaaatacctcaaacagtgtttcctttattgaaacaccaagttccaagtcttggattattaggttaagctctgtcagtagtgagaccaacataaatgcttttcataccgtatgctttgacaaaagagaatagtaataataataaataaataaatgaaaaggaagaagaaataaagtgtttagactgaaaactcctttacttcaccaacctgtttttttaaggactaaactaaaaatccaggtccctgaatgtagaacatataattttaaaaaaatcttttttcaaatctttatagaacattcaaatcacccaatgttccaggacctgaattttttatattttaaaatgaagaaagctgcttaaaataagtgaatcagctgctaagtgatttctctctgtcttttcctctactctctctttaaaaagactggaaaatgcttaaaatggtatatgcaattgatatgtgcagcttaaggagcttaatataattactgaggactcagactttctatttaaaaataagatagggtagggtaacagaaactctgagtggtgagtattcatcccttgtgatggtgaggtgtgggaaatgtttccaaatgtttaatccactgagcaaggtaaagagtgcgaagcagttattcacagaatttggtgtccttctgaaaacctagggaagcctaggaaatccagagaacaactgaggaggatagtatgagagatgctgtgcaggaaacaagcaaataaaatatccatttcttcaatccaatgcttttgtgaagtattaagccaaccaccaaaacattctgattgatttttaagactcttctctaattttattttttaattactcttccctttgtgtattggggtctgaagccttgggcacccattctgagaggtcttgtaaatgtgtctcacatatgcccgtttctcttttgttttctaatatacctttctctatcatttttcatttcccaacctgtttattcacactgtctgcaatgtcatctgaatcctcgaaaaaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaacaggataacttcagtgtaaggcatgtgagaaaaatacgcagagtaatagaactaaaactccatgagggaaatgggcctgagcaaaccacagcatgggtctttttgttaacaaaatgtatgatttttccccagagtacattgatagaggacatagcctacaaaggaccagtaaatgtaaattaactaacagatatgtagcaaatgaatgcatttaaagatgatttccagctgaaatgtttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaaggtaaaaaaaaaaaaaaaaagaaagaaagaaatgagttcatgtttgcctgtcacatagtttgttgaaataataacaaataaaccaataaatgtttattgaaagaatgacctggaaataattttaaagatccacttaaccccttgggttttatttgatttaaagaaaattgtgagagttctgattctacaaagggctggataagtcatccaagaaataatacaggctcttaagagtccactaaacttggatctccaaagttcttaaaagtagtttctgtttctcctttggctccagatccttattatcaaaagatgtgacgagaaatcaaagtcttcttagtggccgggcgcggtgtctcacatctgtaatcccagtactttgggaggccaaggcaggtggatcacttgaggccaggagtttgagacaagcctggacaacatggtgaaaccctgtctctactaaaaatacaaaaattagctgggtatgatggcgcgcatctgtaatcccagctacttgggaggctaaggcacaagaatcacttgaaccggggggacggaggttgcagtgagccaagattgcaccactgcaatccagcctgggtgacaaaatgagactccatctcaaaacaacaacaaaacaacaacaacaaaaaaccaaactaactgttcagtacatgctcagtacttgggtgatgggatcatacataccccaaacctcagcatcacacaatatacccaggtaacaagcctgcacatgtatcctctgaatctaaaataaaagttgaaaaaaaaaaaaaagaaatttgtaactgtgtcaagttgtgtttgacaccactttatagaaatggatttattcttctcctctatcattttcttagcaaaactgaaacacacttctagagtgcaggtcttgatataatcagacatgagaaaatgagaacagttagagaaaatacaattttgccattgtaattacctcttacaaacagcctttcctctttcctgttttatgtgcaatgtgtacagcaacaacaataaaaataaacaaagacatgattaaccgatcaatttgtttctccaaagagagaaatagttaagggctaaagtgcctttcaataattaattataagagtctttaaacttagtattgagaggttacagatttccataccacaaatacattaggttgattcacagagtggccatcaaatacccagaaagcaaattacttttgaccgaaatgtatacatcaacagtacggttaggaatgttttcatagaggaggacagaacatacataaccagttctctatggagcctagcatagtgtcccatggaccaatccacataagataagaccatctacagagcatattcttcatatcacagactctaggtaagaagaaagtattctctaggtaagaggagaaaaataagtgaagatttctttcgttaacacttccaccatgaaaggaatgagctgactacagaaccattttcttgaatatttttgtcttgagtggggtttttatccttccttcaccactctaggtagagcagaatcaccaaagttctctcattacggtaatgtcataaatcccatcctatagcagttgtgcatgatcctgtgttatgcatccaataaagtttattcagaaaatatgtcagcttcattaaacagggatctgatgatctgaacaaaccacttatcttgcttttgtgacatgtattggtatccttaggtctaaaatgaaaatcttggttggtgggggtatctgccaaggattccctgcctcatgtaagcagaatcatctaaccacaattctgagcttaactgggggaaaggaggtggaaggtgtatcgtactagttcgttctaagaaatgtcttatagcttgaggatacgtgaggtcacaaatgtaacaacaactgaactagcaccaagagccaaagaggccaagcataaggaaacctgaagcaagagaaaaaggtgtacgcgtacatacaccaagaagcaaatgctatcattaataataattattgttattacagctattagaatgatgaggcattgatggttcacttgggtgaaatatataatacataagctagaaagaactgtgggtaaacttatggatctttttaaaaggcagtttatattctaggtttatgtgatatgagacacataatttaacaccacatataagaacaggatgctgaaaaaagtgaagaagacttgcagctttaaaatagtataatggctagttcctactggtcttttcttgtgacacctgccttagtcaagccatccgatatagttctaaccttttctgatattttaatgatgatgacaggcccagagtaaaggagacaaaataatcagaagattcagaggggaaaaagaaatggaaagaaaaaaaaagagtttgtattgtttataccatctaatctgacaaattttatatatgctctctgtttgctcaggatagtttattgctaatgttatgactttctcttttttttccatgtgctttgctctaccagttttggctgaaaatattttgtatatgtccatactgtaaaccctcatatttttctagagatttagtgtggtggggaaacttttttttcttccccaagggttaggcacatcaatattctagctactcacttttgaggccaatggaaaatgtgctcctaagattaaatagacctgagtaacacataaattcagtttatactgatgcagtatgttgcatagttacatcctgaatttctgatgcgtgtaatacacctgttggacaacacatcactactgaatagtcactgacctacaattcaaagacagtgagacagcacaagactacagatacaggttctctacagacagcctgatttgtacagagcattcctcatctgtggaactctgtgtgtaaaggatctaggctagccatgggaagctggctcatagagggttctaaatatttttagaataaactagagcaataatacaagcacagagagcaccctttgttatacaatgcataatttctttccccccaaacatgttgtttaaaaatgattcagatttttattatataattcccccttttacatatttctaaatgcctcacatacccatcacatgttttccatgtctgccaataatcttaattaaaaattataaacttttaaagccagtgttacatttgatttaagtagatttgccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtgaaatatttctctaggcaaccaaattgccctgtggcttacagatgtgtctaagaatattaggcaactcactgatgagattttacaatcaactgttacatgttagaaaatatgatgtcaggatactatgaagaaaaatactactatatacaataataagaactatttatctgaatagtttttaacattaacgtgtaaaaaatatcctgatggatctgaaataatgatgtactaaatactacaatgtctggggtttgcttcaacataacatggtgatatagtgagaaaataacaggccatcagttagtcattgtgcaagctggtgatgagtacatgggagttcattatagtaatttgtttatattcatgaatttaagattttttatcataaaaaatttaaaaacatatactgatttgaacttttattcatttattatttgttgactgattcatttactgtttatgcaaggtattattgagatataaataataataataatgctcttattgggcatttaggttaaatgagctattcctcttcaggaatattatatatttattttaaatgtttataaggtctatgtaattacatatttcttaggttaaattttgaaagcaggacacaaaattatatagaaagtatgataacatcatgttttaaaaatatatcctcggggaaaatgagagtaaggaaatatatcaaatggttattaatgattggatttaaattatagaaataattactttaatttttcttcattttactcctatgtgtttttctaaattatttttaatgagcatgtatcattttaaaatgaaaataaatatttcttcattactggaaaagatatgttctccttccccaaggagcttttcatttactgaaacagagaaactgcaaacacacagcattgcccagatagtttaaatctccatacctagaagggaaatacacccacaggaaaagaaacgtcaatacagattttatctgatcatagaaacataaagagctttctctgtgttggacagcaatagggaagaaactggcttgtttgcaagccagcaaaagcgtgaaattcagtcctttttgtgatgagatcattttgtgataaatgcaaaaggagtgacaaattaaagtcaccaaataagcctttcccttgagctcctgaggcttactaatacgagtttcttttggggtagcatagcaagtaaagcgtgggagtggggagggaggcggagctacaatcccgaaggctcctggccttcactggtgagatggatatgctcagagagacagagatagatgtgcaacagaatcagaaacaacaacacagtgacaactatggattatgcacaatggatatggaaagtctctgttagaaaactatctttattaccccaagagattatttccctcagtttatgcacgttcatataaagcgaagtcaagagtgtaacttttaaaggtttggatgaatatgatgttcatgactaaacaggcctagatggagccaggcagaacacagttagatgccagggaagtcacccttttcctcctcctccctctccagtacagttgccagtgcatttcaatgcaggtcagcctctagcaaagtcagctgtttcaagctctgattggataatactttatctatacacccccagtcttgacctgcactcttctcccagtcatggaaatatcaagaattctagaaggccacaataccaatctttttgaaactttacaaactttacaaattttcactacaagacacctagaaaaatcttcaagcctatgcttacctgtagccctggtcttggtcctcttacttaactggtaaaagaggatagccttatttatgtctttgaagggtattttccttttttgcttgttggtaagtacaagagcaaccatgtctaattttaagattgatccaaatgaagcaaatgcatttcaaatttacagaataccatagaatactaatgggtagttcaaagtatcactaaatgtgtttggagggttttgagttttttcaaaacatacaatgttccacacaggaaacatcagtgccaacttcaccctatcactctttctgtccactcaggagtctcctttggaaatatatctctctggagggtcttccaaacaaatcctttgaatacttccatcttgtttagcagagtattctaaaatatttgtcaaaatctgtgataataggttctggagatcatgtttcttattcttctaaatgctggtatttcaaatgaacaaataggatattaaagatctgtcctttaccaatgtcaaaatatgttctgtcaaaatttagtattgctaaagtttagacccaaagactcaccacagcctttggatctcatattttctgaggttcatggaaagatatttgacttctttgcacctcaatattttggactgccatttagagataatgagagttacttaccagacagcaatgtcatgaggaatatcctgttagtaatgatgaaacattctgaaataaaaagagtacaggtaagtgctaggtatttattttaataaatgtatgataacatggtaatcatagaaaataacccatttattcctcactttgggatactgactaagtggtagtatataaaaagtaaaggatgtttccctttgggaatggaaatagaattgtgcactaagaaagtatcttttgtaactgcctgcatgtttaactttaaggtctctaaccagttgcaaccagttatgaatgacttgctgcccatttctgcaattcactgtaacttgtgttgagaaggttatgttttatggttaattatccatggtctgtttaaaaaaataaatcaaaccactgtaaaccactaggatttgcagctccatttgagctttactgtagttttgatcaaacattttgtacataaaaacaagctggtttctctttgtttttagttgtttgttatttgtgttataaatattgtggcaatggtgggagaataagctatggattatttaccctcggtttcatgagttgtgagttattggccttatcctcctttataagtataaataaatgtataatattatattccaagtcttgtaagacaaatggaacgagtgaactgaaaccttttagacccaaaatcttttatgcgaagtcatagaacaacaaaacaaaacccaaattaacatttaaaaagcttctactgtggagcaacaaagtctttaaatattatataatctgcatttaaaaaactgctcatctaacaggcagcagtctatcattctacaagcttttcaatgcctttaacattcagaagctacaggtggttttcccaaagatcactcagcacccccaatatcactaccacaatgaaagccttgaaaatggccagcatgattactttaagccaaaatggatttagaaaaatcaggaattcgtgtagctaaaagtaatgaaacactgtataaaagaagaaccctatagaattttttttatagttaccatcctaggacttatataaacaaaagaagtccaaaaacaattgtccagagaaaatgagaaaagccaagattcaaaggaccctgtggcagagtgcatgaggagcatactcgatagctagaatcataagtatctaacacatttgcatatgaaacttaatgaggatcaccaaagtagcttgccaaaaattatgtttgttaaatcagccaacagtctatgtagcacagacccctaaaaagaacctctaggaaagatgtaaaattgtcttctgaaatttgcttcttttataaaggcagaaaggataaaaaggcctttctcataaaatgaagtgattggtccactactacagtctgaagagttctgtatcagatttcttcttaccctttattacttgtatggcttactgcttacctgcatcagcagtctgcagggttggccatagcaggtcccttacgagttcactgaaacacggaaaatatttatgatggtactattatgtgccagacacaactggatggattctgcttgaaaaggtaagtcagtaactgaggttcttgttgccacattaaaagaaaaaatctatccctactgccaacagcaataagaagagaagctagggtgaaagagttgtcaaagacttatgaaaaattcgaaactgtttaaaattctccctagcttcttttcttgcatgtccaagtaacagaaagcttaggcctgccacctgtcttaagcctggatcccatattaaaaaaataaaaaaaaacagaaaaatgagaaacagctaatgtgttcccaaggccttggttacaacagaaaatgagagccgagaagtctacattggcacacatcgagatttgaaaggtcagtcctgccctagtatggttcagagaccgtgaaaacccaccaagatgaaaatggaagctattctgacaacaagaggcagggaaaaagttcaaagacttttcctctgcttcttttataacgagatactttcaactatttttgacaatcaataaaatgcaaatctccctcacttttgtgttctaagttttttttttttaaatttaaacaacccatttgaaaattagggtactcagaataacttcttgtatacagaactacacatttaaaaagctttgtgcagattgttaatcatattaaaattacatcataaacaatgcactttacatggtgcaaatgttttatgtttttttcttttgacaatcaggcacctacatgcaaaactgcatattggaatccaaactcaactataatacatgtagaggaacccttagaaaaatgcatgtgggaatatgatatcccagttagagactagaatattctgaccaattttcattatttctctgtaataaatttatctgagctatagatcctgttaagaaaataaagctaaatggaaaagtattgataaaatacattaaatatatatatactagcttagtcattattcatattaagatcagaaaagatttccgcaagtcatcacaaatacagagatgggataataccaataatctcgatcacccagttgttaaaacagagaacctcacatttgggcaataatagttttgatttttatcttgtgcaccagatttttccatacaaaggaattctaaattgcaatagttaacacataagacagtgttaaacaaattcataactttagtaaaattaaatgaaccaatttcttatggctttaatatccagaagtaaagtatgatcttaaagaatgatgctgatctgagatacaaggagatcaagcgcttcaatagttcctcctcacacactaatgatcgcatccatcctctcttccacccacctcccaccttttctggttgtattaaaaacaatcaaaactaccaccactgctgctacccttcacacacctgaacttaatttcttctaagagatgcctaacagtgcctagggctgtgctatcactttatatccattttatgaccgcttgagaggcagaaactaaaaaggaagaccaaaacaaaacaaaaaatccctccaacctcccttatcagacaaatgcctggttcccagaggacaccagtcagttaagcaaaaccaaatattacaacagggatgaaggacttataaattgcatacaaatctcactgtgctcccacttaaggtggaaagggagttactccaatgaaagaaaagggggagggggttgtgggaaggagcgaagggctacagaaagagcgagagaaaaagagagagagaaagagagagatttattgtacatttgagacattaagaaggcagtacagtgaaaccaaaggtgttccagggagaaatgtgacagaaagctctaaatgagaattacagaaactattccttcttaaataaaactgttgtttagatgatgaattctataggaagtctgaattaactgtctctgttgtagcatctagatgttttctctttcattaagactttggagtttgaatgtactttgttaaaaaaaaaaaaaaagaagaagaaagagaaaaaaagaaaaaaaaaaaagcattagagctttatatagctcccaaagtaaaaagcaagagaaagatgggtttatataactggcttttttacataaatattacatcaggatacatttcaagtgaaaacacacaaacacacacacacccgtcttccttatactctttctattttaaaattcatttcatactttaaatgttgttggtttttcacaaaataagtaaaaacgaagtcaaaacatctcaaaataagttgccttatattacctggaaaattaacccatcatacaggtcacgatgtctcatttaaagccagttaaggtgctgacaattatgggacattttgctgcagcctagggcaactagaaagggccatggatgttaactaactcccttttaaacagtctgagaaaagggaaaaaaaactgtaagtttccccatctgttatttccttttttttttctttttggctgtggaaaagtaaaattatgcaagagcttttgaatgtaaaggctgtgtgtgctttttccctttttgtctctgtgtaccggttaagtgatgttgcgtaactgagtacagagtaggcggttagcgtttactattgatttacactatgccatctaatgaattcagaacactaaaaagaaaggagcaggagagggagggaggaaaaagagaaagggagaaatagggagaggaaaaaataggaatgaaggagaggaagaaagagcttattcagagaaacagttctaatgactggaataggttcatttttattcctatagctctgacttttggttattgttcagctctcacaaaaaaatggtcttgagctggtgaccccaatattccaatcctatttctaataaggattactggcaggtgaatgcctgaaagttctaatgtgtcaaattacttgaaaccaatttcactatactgtcagactcctccatatgcatctatttatgattctctctatgcatttgtgaatctgtatctgtgatcaccatggatttggtcctactggcttacccaatcaaaaatattatttgaaatatatcacgggaatgtcatcagggtaaagagaaatacattctattttacccatctcctttaaaaatacataaagaacacatttagaactttaaatatatcactattttactttgaaaacagacatgctacaaattgtttggctgaacaaaacagcccaatataggataataaaagagaaataggcaaaatgaggaagaacgctaaattgaggaacaatattcataaagaaatttaaataatttcttatgtctatggagagccttttacttttgtttgggtggaatgcctgtagcattctcagtctttgaatgctgctcagtgcttcccatgccatataatgaattcccaaagcgtggaccagaaagaaagggtgaagttgtttctgctgctaggtacaggtccttcctgtacctgagtgccctcctatggctgagaacaaccactaaggtgagaaagagaaagagaagttctctttagtaatcagctgaaaagctgggcagggaacttgatttctccctcaatgtgtgtttgcaaatgatgactgggaaaaatcacaggaggttatccaaaggaaagaacaagagttggggtttctagtcatccagttgtcttctcttttcagccatctgagcttagaaaatattaaacagatgcgtactctgtccacttgtcaaagatgctttaatgacccatggtggtatgcacacagttgtatacctagcacttgccatggtgcttggcacattttctatactcagcaaatatttattgaaactgaaaaatgatgatgggagaaatatctctgtagaaagaatgcactagaaaggcctgaaaaaatatattccgatgttttacaagaaatcttaggctatattgctctatcattaatctgcacacaaaataatactgtaagagaaatatcaggcagttatttaggggtcagttgacttcagttccattttattaggaaaaagcttaacaaaaattataatactgataacatcagcaaagttttgtgttcatttccaccagcccttttgggctgtctttcatttcagtcttgggcacagaaaagtctattttaatttccatggacacattctaaagaaaaagtcatgggatatcaacgtaattcatcttttaaaaaatactgagacaaatgtagccatttagtaatggaagagaatatggctttttgttgaagggcaaggcaggtggagttttgattaggttacacaaatttaaattactagaaggacaccaagaatgtactgatttccattttcttggttaaacagtttttttttggaaaaaaaaaattctggtttagaaagtcagaaatgccatctttcagttaattggagaataagacctttagaaaaagaattgcaactacaatttctcaaaaattccagcgaagattcaacttaaagcatgtttagcaatagtagccatattcttttaaaaaatggggctaccatcttgttaattctgtaggactgagcatgtagatattagtcaaaaccttcaaaaagttttttatttctctctcttggtcatctatttaatgtaatcggattcagcaacttccttcaataagcattctggcaatatgtcaacaagatcattcatttcatgattcttaaaagtggatgagaacttacctgttcttcttcattttatatatgaagattctgagactcagaattaattttctcaaaagcatatattttgaggcagagctgggactagtatctaaagctcacagttcatttttttcacagcacagactaaatcaaagttgtataaattcaatcttattttaaatgccataggggaagatttcaaaggattcttttataagacaaggaattcttacattatgtaaaatgttcacctcaaagctatcttatacttttttttatcttaaatgtgagcctactgttcaaattgttgcttctccttttccttgtcttaatttttgactctttagagtctttgcctcctgtcctctcacttgtactctgtgtctagttcatatatggcccttcctgacttcatattcttccttctctctctcttttcatctttttatcaaacttttatttattcttgttcctcacagaaataatttccttgttaatgtgatatcctcagaaactacaaaggaagaaaaagtgtaaatttagtattattataataaataggcctttggtttatatttaaaacaaaactgcaataagatattgacaaacagagtaaactacagctataggcttccctatagaaagttacagctgtctagacctccatattatcaatatgaaaacttgggggctagcatttcaaagtatctcatcaaagacagagagcaaaggctcatgatctccagaccactcattttccactacatcaggacacctttcgtttcccttttctttctttccattctacattattgatatttgagactgattacggcacagcaggaggagattcagagaaatctccttggcttaatgtggtcaaactctctcaattccaaaaaaagtcagaaagacctgcacactaaaattgtagttacacagaaaaagaactctgaggaggttaaaagagtcctctgacatgagaaagtagtctctggatagcagggacattgctgccaaaatcattgtaattaagattgggtcattgtttccattataaaccttatgcttatggggtttgtaattcagttaaaatgatcagctgtaggctgaaatgcagccccaagtatcttagagtgggaggtgtttctcccctcctatttcttaaaaaagaaaacacatagcaactatttaataatttcaatgagagttgtattctgacccttcccctacaaagggtagttaatcaatgagcttaatctagagtgagccaaggtgagcaacatccactgtggaatgaagcacattaacctggcatatgaatgggcaataaaaggatttcctattatttcataaggtttaatgtacatcactccattccactgtattgatgtgaataggctttcagcaacaccgtgttgaaaaatctcccacttctgtttgttaactcattattgtaggaaacattacaattataggagacaggaatttctgatggtttccttagatttctttcctcataagctcattcccagggtcagtattagataatcaataatttctaaaatttcttgctcctatttctttagcattgtctacaatatctgatacctatagtgtaatgctatgtgccaccatgatgtagagggattggggaggaaatcatagctatatattaaaattaacaggccagaggaaactggtatttactgagtacatactacatgacatatattccattaatattatttcatttaatacaaacctgcagtgaagtagctgtggcccatgttttatagattagcaacatagttaaagagctgttagctaacctgcgtaaggaaacagagctaatttaaaaagttgcgaagtgaggtttgaatcaagatctgtttgactcccaggcccatatgtactgcaatgcaatgcaacaccaggaacagaatatgaaaccatctaactgaaaaaaaaaagtctccatgccaatgatgagagctacctcatgctccaagtaggaggtagaaagggtaaatgactcctaaaaagagattcttgctttgctcttggctctgataaatccctgtttattcatatgcaaatatccaaatgcatatttggaaaatgttttgtcttagataagaaaatgcacaatctcctagaaacctttaaatgagaccagacatttgaatgtttacaaaaattcctttgaagatttatattaggagaaagttttaaaacataatgcataaaaaaaaatcagatgattggctaggcatggtgactatcgtcaccatgggagtcgctttgggaggctgaggtgggtgcatggcttgagcccaggagtttgagaccagcctagacaacatggtggaaccccatctctacaaaacacagtgaaaaaaaaattagcaggcatggtggcacgtgcctatagtcccagctactctggaggctgaggctgaggctgaggattgattgagcccaggagaccgaggctgcagtgagccatgatcgtgctactgcactccagtctgagcgagagaacgagaccctgtctcaaaccctccacccccaaaaatcagatgattaatacaacattaacatttcaatctggatgtgtgtgtttgtgtgtgtgtgtctatgtgcatataaacctataaatatacacatacacagatgaatttttttgtctttgtcaaaatttctggtaattattataaagtatttgacaaaagctaaacagtaaatatgttacaccaggagaaaaggaaacaaagaacaagaaaagaggagtatgtgtatgtacatacttccctcagaaatctaatcctaaaacattttttaagctaaatgggacatagtgctttagtctaaattgtgtgtgtgtgtgtgtgtgtgtgtatgtaaagataaaggacttttactatgttattttggcaagtgattatttttctaaaatctttgctgaatcgttttatgtagatatactataatactcttgaataaataaatacttgttcaagttaaccttagagctcatcaggtaaataacagaatttaaaaaagaatctgtagtctgaaacactgtagagtatgccaactttacacattacattaagtattcgttcaaaataatttataaattgaaaagtatactccattttattcaaacaatgcaattttttaaatgaatcttacacaaatttgtgtgtgtgtgtgtgtgttagagagagtgtgtgtgtgatcctcaagaccactgagtcattctttaaaaatattttaaaatcataatttggtgaagaacttaacaacaaagtaactgaagccagatttgagagaagaagaatgaacagttcttcaggaagcaccaattcattccttaacattcaataagtctttattgcttcgcccttccctcctttttttcctctagtctaaactctgatttggagcagaagttaggaggaacacgtattctggtccctcttctctcatccctgtaaggaaaagcaatggtagactaatgacagaaaaagcaattgcaacaactttggcagttttgtggtactgggaaaaagcaggctttgtatttgtacatttcaaggaatttcttcaaattttagcttctttgaatgttcctacaacaagctgaaggggagataagatctgctagggaaatagatgaggtttagagagggaaaatggagggactactttttttttattcaaatagcattcaaacacatgagcaagatataacttgcaacattaaaaagtaaattagctagctaaaaataactcacaatacccttctcactaaaacaaaataaaataaagcaaaaactcacaaccaattattttgactggtaaaaacagacagtgatatgaaagtaacagatggaagcccagttttactcacacaacacactcactaaagacaattgcaagtgtccccatgacaataacttaacaatggtcactttagcctgagatatctcctttaggtgagtttccttaaagacttcagaggggcttgtagaaaatactgtagaacgaaaccaactcatttgtctatatgtagaaataggcaagagttgcaaatcacagcctgtggacgaaagggatccaggtgtcacatttgccaaatctttttgcaagactggaatagatattcttttcttatttattttttgttgtatggcagtatttttaggagtggtgacatttctgtacttttaaaaacacaacactacacagcacctaaaaactttcctaaatcaaataattaacagtaataaatcttcctgctaatttctcctcaaagttgaaagaaaggttattttcttacctcacactgagccttctgatatgacagtgtcattcagtcaataatttcaatgtcagttactgatttctaactcttttattacaaagacttcaagcaataatgaaatggtgctgatctgcttgctttcactctatataacgtctatatttatatgcttatgcttctatttggatctatatttatctgctttatctgcctacagtgcatctgtttctcatacacacagacatatatttatatatatacacacatactgtatatatatatataggttatatataaacacacatacccacaaaaatgtatgaatgtatgctagtgagcttacttcaacaaccatgcaggtgcataaatattcaggcacatgacaaatatacaaagaacataaatgaacatgtaaacatagttacacaggaaaaagaatatcttaacaacagccctgtctgccatacttggctgttggcctttgagacttatacactgttgaatgatatgtcatagactactctgagaagcagaaaaatcttctgaaggcaaaagtatatgactaaatcaagataatgaattctaactctctcattttcgcaatgaggagtctgagatactaaggtgaacagcaaagattttacagctttctggaggcagagctggaagttttacccaagtctctgcctgctagacaaatgctctttctactactatgctgaattgaaaggatgaaaacaattttttcaaacccaatatcattattttctaattgccactctttcccatttttcccttttcttgctgtgtgaaatgtaaacaaacaacattcactcagggtcaggcactgttctaaatattctatatgtactataccatttaatctgtaaaatatctctatatagtaggtattattattcaaaatcttagtttagtgaattaaataactcactcaaagctacacagctagtaaggaaaagggctgagctcccataatactcaagacccatgtttttctcacttaactatgatgccttccctaatacatatttgtatataatactaacccttccctcaccaccacagcctgatagtcttagaaatctaatatttgatctgtttcagaacacataacaagtttaaaggttctctcagcctgaggaaaaaaaataaagggaagtagagcaggtataagttacatccctagtatgcagcacatgccctatactagagaactgaaatatgcaaaattcccccccaaaattactccaatgatagtgtgatgtgatttaaagccttaataacttccagtctatgaacattttatgtcttttgcaaaggattatggcaaactgataatatagaatcagattggaaataagaccacaagaaggcaaagggaaaatagcaaaaggaagaaagacccacacccacttcttcttcctctcttggcacaacacttccaaaaacaaacacccattaaaaacaacaaacccagtatcaaaatttggtatttttttccccactcaagtgttagagacaaattcagaaaagaaactaagtctacgtatggtaggtagttttatacaaatctcttcagatagtaaccagttgtgagccatccgaacacggaggaattttacactttggccagctaacccagaacccagcactgggagatgtcatgtggatttgtgaaactccctggggcatactgcatccataagccaaagaacagaaattatactgatccatacatgcagctcttcatctgtgccatattgataattactcttcatttgtgaattaaatcctagttataaaaacaactttcagacatttgtcacaaatggcacattttacttaactctttcataacaccatctagccacggtctataggaaatgggagctaccatactcccatataggtcatgatattataggaagaatatgatgtagagaaagagagagagagagagagacagacttgagtttgaatcccaggttttccatttattaacaataaagctgtaggcacatcacttaaatgattctgaaacctcattttcatcacctgtggaataaagaataaaaccacctattttgcaggaacgttgtgaagattagagacatcccagcacaaagaccccctcataaaagggggcattaaatattaattattgtatatttaagaagtctatttgtgtgtgactttctcttgtattaatgatacataaatctgctgggagtaacagaagatgtgaggtactttttatgcttttttaatcaaagacaaactttttggtgatcacatgtgttccatgtaaaagtggaaataaaagcatatcacagtgtaacattttcagtggacgattttaaagcacttaataacccttgactttttgtgattgctggcactctcatttaacagttgggcaaaatggggttcagagatacatcctccaaatcagtaataataataaagaaatcaccagcaggggttagtagaaagtctgtttttaacatctaaatcccacagtgtccagctaaggaataactgctgcaaggtcacagatacaaaaggccacactttccccaaagctctttgagattattcactgaggccaaaacattaggtaatgctgtgtacatctgctgagataacaagggtgagtcagggttaggtcacggtttcaggttagaggggtggggtgaagagtggctttcagatcaaatgacgagagtagtttaatttaagcaaagaacaaaccatacagtattttaagtaagaggggaaaaaaagggggtgcaactacagccaagagaaggtgggtgggaatatagaccctgtgggggtcaaatgggtaactgtggctcaaagaggaaacccacccacattcacacacactgaaaagcgaacaaaaagcccagggtgcagcataaatcctgctatcccaataacacacacagatgttccaccattgttttcttttatgcacattttaattaagagatcagaatcaagcattaaaatgttattaaatggcttgtttacatttttgctatatgtcatttataatgcattttctaaatgtgtgtatatctattcggaaggactatttggaatttttacatcagtgctacaattgtcccactaactcacagtcatttttgctaaccaaatatgtgtcagaaatccttttcagtttaagcaactggacaggagctctcactctttaattctcagtcaagcaattccctacccccaatcacacctcctttaagcatgacaaagtccaccacagtacttcaagacaataggaaggcccaggtacactggcaacctttctgatttttcacaagagtcccagtttcaaatattctcccattgtgctcacaagaaaatagtcttcatatacatgcccgaccctttccctagaacagttttgaaaatgtcgggaactcaaagctaccacatgaaggaccctgacctatgagtgtcccctggaggggacacagtggaagaagcgggaactagtagatttttttttcctccccacaatccatcttctatttgcagtctacaacttatccctatttgcctgggcaggaatttgagttctctatattattctggagttaaaacaggtatgcctttcccgtctctcagattccacagatatcatgactgatgcacacaatccacctgcatatgtggatcacaagtatcctgtagtctgctggcaccatataacttaattacttttaaccacagggcattgtcctagaagcccactatttatattgtaccttatcaatcatggtacttggaattgcaaagtctcagaaagcaggaatcatatctcctccacgttcagttcaatgcctaatgcattgtgagtgttcagttaggacaagcaagagaggtaaggttttttctttctttttgttatttgtttgttatccaggataagcagaatgcttgtacagaacatgcataagaaagaaacgcaatctaatctcactgtcaatttatattctgtaaactgtctcatttgcagcataaatgactacaaaaatgttttggttactctaagtgttaaccttaaggtaagagttaaattaagtctgctataactggtggaccagaaaggactcagagaaaagcaacagcatggctttgaatcaaatcacttttggaagaaaactttaagatgttaccaccgaaaaaataaaactggcaaaatgctctggagggcatcttagcaatatgcatcaaaaatttaaaaaatatatgaagactgttgacccagaaatctcacctctaggaatgtatctaaaggaattactcaaagatctacacaaagatttagaagcaagaatgtttaccatggcattatttataattgtgaaagactggtaaccttgtctgacaatagagagttgattaaataaatgacagtacattcctagacttaaatactatgcagtttaagaaatcatattttagataccacttaattacatgaagaaatgtttttggaatactgttaagtgaaaaggcatataaccaacaatatatgtacaggaaaatatattgtttaagtaaatattgctaagttaaatattgttaacttaaatattgtttaagaagtgatagttgtgtacacacaaagtgcaaaaagaccagaaaacactagaagtgcttgtttctgggtagagaaattataaataatttttgtttatttgaacttttccataataaaagcacatttatttcatagtaaaatattacttaaaatattcatctataccaaccttccttctctaaaggcctaaaagtgaccctctgtaggcactcttttgtctctagaagtcttccttctcctgtttttatagatgtatgtgttgcattctaaaatcttaagtatttgggactatgtagttataaaagataccctaccaattaaacaaataaaaaatcttattaaatctgtggttttaatcttaggttcctgcttagaaaaaataccaatttctctttaagtcctatattttgctttcaattcagcctccatagtattaattagttatattatttaggcctgcagcagaacagtttcatagttcttctcattctcacagttctttgtaagagacaccacccctctcatggttcttactcacccctacacccacaattgaccataggtaattgtgcaagagaccacaaatagaaagaaaatgaaggaagccttaaaaggccaaggtagttccaagttataaaacagagaaaggctgaaaatttaggcagagatgtggagaaaatccgagccatgacacttaagaatgaactggagtaaagatccatgagcacctggtgcagggagagacaactctacctatcaatccagtacatgctactcacacaggactattaattctagtaaataaccacagctttaggaggggcaaatgttctggaataggctgcctgttgaaaatacaagtgctagggcctttccataacctataatcaggacttccagaagtaatatccaggcatcttcattgaaagctccaaatgtgattctgaattatactagaggtgagaaccaatgggctactggggaagttcaaatcccttagctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagttaaagttcactttcatctcaagagaaaaaacagtcattcctgacttacaaacatgagtggagggaagtacctgaacacagggattgctttcctcacatctggctctaagatacaaccacgcgctgtgacatataaaaaggtcactgacacgagaaaatatcgcaagatattacaaggataatcaaagccaaaatatatccaaacccacttttggagagaatcccaataacttcttttgaatgtgataataaaaataacatgaataaagatcattttcttaagaaaaaaaaggaacgtttctatcacttgcctgccacttgccacttaggagtagactctggctcccttttccgcttaaattcttccacagagtcagcttgccagactcttaaccaaggtttttcttttatctagactataacaaatactccattttgggtcatgagaacatagtagcaaaattcccagagttaatactttaattatacacatatgtatttattattttgtatgtgtgtgagctgttccactaagttaaactttaaccatattaatccaggaaaaaaatccctgattatcaactaacaattttgtaaacagttatctcacaggttaaatattaactcgaaaaatttaactcaaaactccacacaagcagaaggagccaaaaggccaggaagaagaagtaaagattagctgctttaggaggaacacagccaggaaagtgagcattttggtagctggataatgtgtaggaagtccagggggttgtgcaggggggggaaatagaagcaagaagggagcctggaggacacctgctgcttatcataatatcaaaacataaaacaatgaggtgagaccttaaggaaaagaaaattcatggagatatgaatccattgataatggccacaggaattcaggtgcaataaaggtttgaacctcaatgatatggacatagctaaaagatccaacacaaagctagctggagcggactgcctgcctgccactgaatatcatgaggaacattctggggtccctcttccactagaaataatgggatgaaggctgctctgcctgtcctgtttctgtttcctaacaataaaacaaaactgaagtgtctccctccagtattgggttattaggggcaccgattgcaagttctaagcctttatctaactgtccatcaattctctccctgattaacagaaccatatcacgtaagaaaaagttggaaccagcagtagactaagtcagaaggcttttctgtaccggaattgctgaactacaaatattgttctctggttaggattttgactaaaaaatgtcaagaaaatccacatggccagagaattcgcacaatcttgatatctgaggtacagggtaaagctgatgtattttaatgctgttttaggaaggttagaaactgttaagattcttcctgtcagtatgtcaaatatcagatcagtcctgcttgctgatttttaaggaagtcattaaaaaaatcctcccagtgagtagctttcaaggaagactcccatttgcccggcagatctaaagaaataatgaggccaaataatgcaagtttctcaagagaggtgtaggattgaatgaaaaaagggaagatatagaaatgtaggagaaataattcttacatatataatatatataatgtatatatgtatatattgtgtataatatgtatatattgtttatattcaagaaatatgatatagcttatcatatattacttttgatatttttcttatacatctagtacatgaatacatgcttattggaaaagtacaagtacaaggtgtagtctctattatctaaatatattatttaaatatatatctaaatatattatctaaatatagatgacacctcgtacttgtaaagctttttgcagtttataaaatatttttgcataaaatatcttttgctttcctgacaaccacaaaaagtaaaaagggtgggttctataatttctgttctatagacatgcaagtattactctaccattgacgtaactggtgcagaataaacctgaacagaggaaatagaatccattagtagcctggttatccatatccacatgccaagtaagaaagcagcatgatgactgtggaaatgtaaaggcattataagagtgatttttggagaggattaaggagggagacatcaaaataattcaaaaggaagtttagaaaatcagtagaaataaagggctaaatttggagtaacttttttggaaaaaaagtgtttagaacaaggaaagaaacttccaattcagaccatgtattcatttggcatatactaattgtatatctatgtttgattttctttgatagatgctattgggtaaataatgatgtgtatggagacactgacctgtgcctgacatatttaatatctatttgttgggataatgcccagaaggaattattatgcaataaaattcagatattcagaataggggtttagagagaaaatcatcactgatatgtaggctgacaaaggaaagcttcagtatgatgaacaaatctagttatactttgaaaaacatgtaagatttgggaggtgataagacatttcaagttgtgtgaagggcatgagagaaagcatggaagcagaaaattgagatatgtatttgggagcagcaaataaacaagttagttggaattgtaataggaaacaatgctggaaagatgggttgagtgtggaatgcgaaacggggtccttgaataatgggctgagtagtccactttattctgtgaacacaagaggtctattaaaggcttgtaaagtaggacactggcatggtcacagtgatattctagtataaataattgggaatggtggacagaaaaaactgaaacagggagagcataaaggtaatgagagagaaagagagagagtgcgagcttgtgagagcaagagaatgagaagtgatccactgcaacaacccaggtactatgtgataaatatctgacttcggtagtgtcagcagaaatgtacaggaaataacatgttctagagacattgtggaggaaaaaataacaatatttactaaagttctactctgtgccaggcaccgaactatgtgctttatgtagattaacccattaatctccatgctaaccctaagaggtaagtaactttattgtttccattttacagataaggattaagcaactttttcaaggttatgcagttagtaagtggtgaagcctggattcaaacccaggcaatctgactccagagcctgttctcctaacccccacacttactgtttttcctaggtacaagggatcttttggtggattatatatgacaagatttgatataatttgatgactgactacatatgagcaataaattcgtgggattcttgggattctcaattctgagatttttgggttatattatgaataaaaagaaggaaataaagaagatcttcttgacttcacattgtacatttgttcctaatggtccaattgctttttggacttaaagtatcaatttacaataaaagccacagaagcaactgaaccaccaaaccggaaagctctttgaaaatgattcttctttctagtttcactaatgtatatctggagtatagcacagttcttcgcatataggggatgcccaacaataacatgatgaatgagtcaactggagaagtattaattgtaataagtgagaataagggagtggagggtgtaaaagtcaaaagagtatgacccagagtcagacaaatattggttcatatcctggctcagggccctttctaactacatgacatacagaaagttactttaaacattttgtgtaatatggggtaataattcataggaaagctagctaccttactggattcagtggttttatataaaggcaatgggtgtatgcaaacctagtaaggaatgctcccaaaggctgttacctctgacagaagaaaatctgcaacccctttctctttgtttaacttacaaaaccacatgaagacctaagaaaaaaaatctgccaaataaattccagttacaaaaggaaaataaattattttgaaagtaaaaactataatttcaactgaagaagagattttaattgcagggagatagatcagttgaatggtttaacttggacttgagaaatcagtagcagccagtgggatacatattaaagaaaaaaacaagtttaattacccttaagattttatacagcttggctcttccctcccacacctagtctgcttccatcaggtcagactccttttcaatcacactctcttccatccttttctcagttgctgtcatgacaagccaatgagagaatgacataccgatgaaaacaaggtttgagtaattactgcactgtggctggttgttgtctgggcatcattttatttcttccaatcaaacaggtccttggacttcacagctctgtttcaggtgggggtgatgctgattatattatgacattatagcaaagacaggcagatcagatgaagtgaatttcactcagtaattaaactgcagtttctttcgtctaaagtccagggcaggattaatcgaaacgtagctctttatcattcctattaatgctgggatttgaagagtgagctctgatttgatagctagccctgaatctggctgactggtgtccccaaatctgtctaacttgcaaaaataatatcagatcaagatacatttgcaaggttatacccttcccttttattttacttttttttttgataaggaaatgcaaatagattcaaatatgctgccatttccactaccttgttttctattacaaaaatgtctgtgaaaaaaatcaggtccttccaaaccccacagcattttacaaatggttttccataattccacttaacaccatgctctaatggcttctaattttgtgacttttcattatctgagactcaatatgaatatttggatggcccaagcgacagcttttcagaggctcaaaggttctacttttattttaaaggactcattctgggacttatatagagattttgtttcattcaatcactcttgtaatgcatatgatatcaccaaattctttaacaagtatgagttggatcactgattctcaatcctgggtgtccatagaaggacctgtgaagctctgtaaaaaatcagcctccagcctccactccaggccacactcacagatcggaatctctaggttttagacacaagattttatatattcttgaactccataagtgatttgaatgtgcagctagagttgaggaccagagtcagccacacagtgtattagctgtatttgcaaaatatttattaaaacaagccattgttcagagaaattagcctcacattattgtgagagatctctcaataaaataataaaaagcttattccagtagcctttgcatagaaaaagatatacttgggtttctttccttcttttcttttttttttcttagacggagtctcactcttttgcccaggcaggactgcagtggcgctatcttggctcactacaagctccgcctcccgggttcacgccattctccttcctcagcctcccgagtagctgggactacaggcgcccaccaccgagcccggctaatttttttttttgtatttttagtagagacggggtttcaccgtgttagccaggatggtctcgatctcctgacctcatgatccgcccacctcggcctcccaaagtgctgggattacaggtgtgagccaccgctcggcctcccaaagatatacttgggtttcttaagggaagtagaggaaaaggaagactgtaaaaacagacaggtaactgttgatggggcttccattgttctctctgataacattgaaggtgatggtttactgattgagctcatcacatggtaacactatagctaccaaccatataatttaagatgacagttgactaacatcatagaatctcagagtttggacataaacttggaattagctgtcatctattttaaccccttctctattcagctgcctttttagaaagagaggcagaatttagaagactttatttcaaattctgttttcagttctgtttcagagtttaagaatacacgttctagggtcaaactgaattcaactactagttgggtggcctagatatttacttctctaagccttaattatcccttctttaaaatgcggcccagaatatgtatctcaaagagctatttaggttttatattaattaatttagataattaactagaatgcctggcacacaaaagtatcagaactcaataaattaagtctattgaaggaaattgcaatagtcacttttaaggttgtcactgagactctatgcttaacaactatcagtttggtgactcacagatcagttttctggaagatttgatttgccaaagaaaaagagagtgagtccaaataggaatggctttcacatttaattgagccataaaataaaatacattttattaaataaattttataaaatacaattttattttaatgatcacctggaaatgatcattaaaaatgcaaatttctgggctccaatcccagagattctgattcagtttgtaggagtggagtctaggaaccatccaggtgattctgactcagggtcaagggtcttcactttaataaagacagttataaaggaatataaattagccaagcatttatcccccaaataactacagtgtggcttgacctggaagagaccatgctttctattccttaagtcagaattcagttagatgagtttaaaccatgtgcaaatacaaaatgtttatagagtatatttatgcacacagagttaaaaaatctatttctcttcaattaaatatgccttctcaacaattatcatttagccactaacattatcttcatctcttttcatcactactgggtacatgtaagtatacagacaagggtcagatttgctatcgactcatccattttcttcttacaaaataataaacaggtttcataaaattggtaaattccttgaataaacaaaagcagctatttcctcctctaaatgcattgtagaataaagtattttcaaaacgcattaatcgaaattgataatgaaagtcaatatataattgtgagttgaatattttaaatgcaattgattacttcgctaaaatgaatatactcaacttacacatggagactgttctggatctaaggagaaatttaaacattttcattcccaatcagcgaaatcccagaaatgtgtttagagtttctaatacaatataccaacaaatgtgcattaactctctatattctaaaagttattgtgtaacaaataacaggagaattatggtctctaattgcagttgaacataaaattgagctggggagaaaataaggcatcaacatgagaaaagtttttcagcattatacaacaatataggctagtggccaagtgtaaggctgaaggagaatctttttagtacatactgtgtgaggcagggtaagctaccgaagatctgcaaaagtcaggcacagtaactcactgagggggttgtggtgaccacagtgggtactgaataaatgtaacctattatttattataatagttgacagtttattttagtaacacaagatatatcacagataagactatgtaaccggtaaaaggtgaatggtacaggcactgagagttacagggagccaaaactgagagaatgctggcatgactggtaagggttttgtgaggaagagacatttgaatggataatgcaggagagagaggatttggctagacagaggaacaaagatcattttagacagggtggggtgttttgatatgaatcgcaggtcaaagttaaaaagtgtttaacgactgttaaaaaaaacagtttaggatgaagccataaagataaatttgaagtagaacaacagagggttctggattccaaaaatcacttgtagtttctggtagaatttttaattgtcaaaatattttctcagtggaattcaatatctctttagatcagtggttctcaaattttagtatgcatcagaattacctgaagtgcttgttcaaatacaaattgctgtgttccacctcaaagtttcttattcagtaggggaaagtgaggcctaagaatctgcatttctaacatattcctaggtaatgctaatgctgctggtcacttggagaaccactgctttagaagacagtgagataggccgggcgcggtggctcatgcctgtaatcccagcactttgggaggccaaggtgggcggatcacgaggtcaggaaatcatgatcatcctggctaacatggtgaaaccccgtctctactaaaaatacaaaaatttagccaggcatggtggcaggcacctgtagtccccgctgctcaggaggctgaggcaggataattgcttgaacctgggaggcagaggttatagtgagccgagattgtgccactgcactccagcctgggcaagagagagagactccatcacaaaaaaaaaaaaaaaaaaaaaaaaaaaagtcagtgagataagagaagagttggatgaagagtttcatggataagaaagagttggacgactatttcctaaagtcaccatataatggaatagccctctttatttcctataaaatttcaccctccctttcataccaacacatagagaaacctacatgaagattacctagggatcaaaattcttctttggctttctaatccctctattgggttcaggtccttaactgtgggaatgaagaggcccatgatcaaaaggagcccaggcccaccaacctggaaacttgaagacaacttaatcactattaaggatattcaagaattcaaaataacagacccaagagactaaagaaagaaggtggaatttttattccaaaaagcctctgtcagtttcatgttgaacattttgtacttgggctgcacttaactgcctgccccttaatccacaaactaatatcatctcaccttggttcacctttttcttttcttcaaaaggcagtcagaagcaagcaggggcaatgagaactttctacctaggcatgggccactgtttaagcatctccaccttctgcttcaaaatctttctccaaaacaaacttccactatgtggtaactatactgtaagaaatcatttaaaaggcagaaagaggaaatgaaatgctctgagagactattttctcatgcataacttcgagggcagtatctcacaagtcagtactttatttttgatggcagacaaaaaacatgttgtgtttgaagattcatgtagaaatctttgtgaaaaaaggtcaaaattggatttaaaatgttcaaaactccaaaaatctctaaagaacaggagcttgtttattttctagcaatttatctttccttaaaataagaagctatataattacaaagtataattaataataataacaataattaccacaaatacaacagaaataatgatagtaagcaccatgggcccagatccccatagttacaaaggataagaatttgtctcagtatatttgagaacagacagcagcccaataatacaggaaaaaaaaattggaaaggaaataatctttcttgtgctccctggaaaataccacagaaaaatagacaatcaaatttaatacctgttgttaaatatcttcattgtacagattaggtcaggcaatttaaatagacaacaacatgaggcctctaatgtctcttaggaaacagtttcaatgtaaattcctaggaggtcccaattcaatttctagttaagcatccccatccactcgtaacactcataagaaggagaaatgcatttgtatggtgttttacagtttataaattattctcacaaacgtgttatttgattgtctcaaaaatcctgtggggtaggtaagtagagaaagtattaatagtatacccattagaaggtgaaagaattaaggatcagagaaaaaggacataaattaatctttattaaatatccacattgggtcaaactgtgcagacctggaaagaagtccaaataaagttttacataacatggataggcttggagaatttgttaactgcccaaagtaaaaaaatggaagagctagaacttgaatgcagataatgcagctcaagatgtaatggtctttccatcagaccatagactaaactctcagttgtaaccatcgtctagttacagtaactgcccctctcaagaggaggctatttcattgccaagaaataaaaccgtgaatagtggtcaggttttctgtttttagttagactgaaagaaagcacatactccttgagaagacgtgcatctttttaacatgacttagtctgtcaagagaataagagagagaatgtgttatttcattcatgtagaatactgacttttaaaagtcactcaatttctctaatgatcagtgatgttgagctttttctcttaggtttgttggctgcatgtatgtcttcttttgagaagtgtcttttcatgtcctcaggggagggcagtgtgggggcagagagaatcaagaaaaatagataatgcatgcggagcttaatacctaggtgacaggttgataggtgcagcaaaccaccatggcacatgtttacctctgtaacaaacctgcacatcctgcacatgtgcccaagaacttaaaattaaaaaaataaaaaataaaaaaactgactccagctacccatggacacaagagacaacacggtcccatttgtcaccaaaatagacaacacagtcccatttttcactaacatactctttgcaagaaagataaactaaaagactatccaacattaatagctagattctggcatagtctcagcttaaactattagtttctaaataagaggcaatacatatgcatagtaaaatagagaataacagcaatggatgtattaacaaaatgcattttccattaattgttatgaattaaaaagtctcgaagctatagatcgagactttgaaacttctggaacaaattaacctatctctttttatttttactttatgcatgcatttacttgtgtagttggtgttgctatgttttcttaaatttgtttttaagataattatattctccctctacttttatacatatatcttctgaggcatttaaaggtttgacaaagcagtgtcttctcacaagagacagaggtttcacttagaagccatcttgggaatttgggctgcagaaatcaagggaggtctagtacgtaagtaaatattagtgcaataatattaaatttttgaatactaaaggaaaacatttattgaaagaaaattgctttatatccttaacaactaccttgctatcgaggatttttagagaattgcagaatttcagagttgatgctatatgtaggattttcttttcttttaattttttttttagagacagggtttcactctgtcacccaagctggagtgcggtggcatgaccatagctcactacagcctcaaactcctgggctcaaacaatcctcccatcttagcctcatgagtagctgggatcacacatccggctaattttttttttttttttttttttgtatagacagggttttgcttgggggcccaagcttgtctcaaactcctgtcttcaagtgatcctccctccttggcctcccaaggtgctgggattacaggtgtgagctactgtgtctggccccaaagattttatttttataatgacagaatatcagtgttagcagagtccattaaaattatatatgacaatcatctgtttaacccatttatgccaaatgttgcaattttgtgtgtgtgtgtgtgtgtatgtgtgaaaaatcagaacttggtgatgaccttgagcaacaggatatacataactgccacaagcttagcattccaatagtggaacactaggcataaatgggttatggcttcagtatcctgcaaaatatccctgtaaggtagctgtctatgcttaaacaccttggtcttaggaaactaggatttgtggatattaggcaatgttatgggctgattgtgtcccctaaaatacatagggtgaagccctaagctcctaccaactgtatttggagataaggcctttgaagaagtaattaaggtttaatgaggtcataaggttggcactctaatccactaggactggcgtccttataaggacaggaagagacatcagaggttctcttgagctcacaaagaaaaggctgtgtaaggacacagcagcagaaggctatctgcagccaaagacagaggcctcaggaaaaaccaaacctgatgacacctcagtattggacttctagcctccagagttgtgagaaaccaatttctgtttgctagtccacccaccttgtggtattttgttatggtaggcctacagactgatatggtgcctgtatcagtgcctatatggtgcctatctcatcacaacctgtaaggaaggaattacttaaagccaatttataggtatagaaacagactatggaacattcaagaaatgtcccaagagacaaggattcaataagtggcataactgagatttaatctaggtctatcttccatattattttttaccctcctattttttacctttgaacacagaaggctgctacaaagttagtgtttcatattgacttgagtattttattcttgtaggtttcatcactggctgatggtctatttgttggagtaacagaaagcaacataatttatcttttagatgactgtcattcatatacttgaagatagttattacattccttcctcctgaatttcctgttaatcccggttcccttaaccattgctcatatcacatgtttcagttccctaccattctggccacttatacctgaagatgttcctatctatttaaatttcttgtactgggttggaaagtcatatctctgctacgtcattcatgactagtctttttaaaatataaaggcaatatcttgcatttatccatttagaaaatttcatctgttagatgtagcccataattccagtctttcaatgtctttggaattcgattacttcattcaacaacttttctatgtatctggactcatgtcatctgcaaatctaatgaatatgttttcattccagttattgaaaaaaacttgtgaccaagataaggccgaaaatatccttgcaatatgccacaggaatcccctatattatgatattgagccatttgtttgtacctaatagtgtggtcaatcaaccagttactaatccagctgtacctacattagttactaatccagctgtacctagattagtaactaacccggctgtacctagattagtaactaacccggctgtacctagattagtaactaacccggctgtacctagattagtaactaatccggctgtgcctagattagtaactaatccggctgtgcctagattagtaactaatccggctgtgcctagtttagtaactaatccggctgtgcctagattagtaactaatccggctgtgcctagattagttactaatccggctgtgcctagattagttactaatctggctgtgcctagattagttactaatctgtctatatatctaacccaggagatatcagatcacatattgtagacatcattttactgaagccattctattgtctagcaagcaccacttctttcagtggatcatgatacattgttttatactttattgctttaataatccattctagactgttgctcaggactaacagcaagtagttgcatcatcataaattgcctttctatactttctgtaaatcagaagatttccacatctctagttatctaacattgtttctcttctcctcaaacatggatggtagtaattgactatctcattgacaaatcctctcatgagtatatggttctctatccctatttttaggctcttctccttttcctttttttcctgttatcttccaaggaaagagtcactcatgtttaatcatgaacggtatgttggtcagagatagacctgcaaactggaacaactgagaagatttatacaaagtgttgtcctagagtccctgactgtgcccgtagaggaaaatgtactatgattaggtgaggctttgctctcatctccacacagggctctgcatggcttttctatttcacttctggcagtactcctggggaaggctacatccttttcctattcattctgggtgacttcctttgccaaagattcaagacagctttgtatttttcagtctttaactgagaaaggttgtgatatataatgcctttattttcccatgaagactttctctgaggcatgcacatagccacgacctttacctaatcaagaaaagttgcttgggcagtgggggatggggatgcaggttggactttaaatgcacaaatcagttctaataaaaacactgagattcaggtgcctgaggttagaaatactggagggaattcaattacactaattaatatttaagaagggctagagatcacacactgaatgtgggaaactaggccagtcagacatgagcatatggggagggcaagatcaacagataaaagtaacaaacaaatcatacataaatgctccaacaggaatgaaatagagaatataaaataaatgttccaacagacactgaagaggaggtaaatggtctaccagacataaaagcaaaatgttccaacatacacaagacattttattggtttaatgtaaacacatatattataaaaatgatttttccacataagttagtaggaaatgttacccatttatagaaacagacttacgggttctatgaattcacagcatactatatttgctctcatttcctcactggctcatcatgcaggagtctcaataaggcttgactttcataacaggtagttctccaatgcctaagcctacctggatacccaacgcctgacagaaggctgaaaagctgcagagtgtgcctgcttctgcacaagtttttctagttccggttgctctaatgtgatttggttggtgtcacagctaataccacattctctatttgatctgatttttcatctgtggcccagacagttgattctgatttttggtcattcttttatagacttgaaagttttctagagaaggcactagtggtgccaggactatcttgcttccttctgtcctgtctacactagcatttaattacacttttctacctcttttctacctctatgccctctcaccctccttcatcttgggagcttccaaaactagaagccaagagaattaactaggttgctttataaaaattgtatatatgtagggtaaacatgacattttgatatacattggattgcttttgctatcaacggcatcatgtagaggtagtagtagaagcatggaagggtagaagaaaggactgagactgatatttggactcctctttcaagttttctgatgtacacatagagtaactagatggcctggactgtctatgtacaatacggaattttaggctcctggaggaaacaaaccaaaacaaaaataaaaacaaagtccttttccttcagtagctttagctttagaagaataaatgattcacatataccaaaacccacaagatacggtatccccaaaaagttaaattgtctcttacctaatagaggatcagaaaaagaaaagatagttatttcctaaaaattgtttgaaccaaatttgtggttttcaaactatgcttcatggtccccagacttacaaagagatgattacaaaaagattatcaaatagatataaataaataaaaaaataaatacatatataatatgtagtaaatacatatatatcaatttgcaattgtgataaaaatgacatgcaaatttaaatgtattatataaatttaaaaaacactggagaccaatgtgttattacaagttaattatgtacaataagaataagcagctttcatgcaggcctctaattaaggctctcagattggaatacaagctgttgaaaaaaactgttacaatatgcaactacttatcagtctcatgatttttttgataccatatagtatagtacagaaagtcttcacttattgccatccataggttcttggaaactgtgattttaagtgaaacaacatataatgaaagcaattttaccatagactaattgatataaataagagttaagttcttatggcaaattttgggtcacagaaacatcatcaagtttctaaataaagatcaaaacacttttgatattaaacattgaaataaatgtgagctgtacatgcatttaagaaagattaataaaagcaagaaataaatgtgagctgtacatacatttaagaaagattaataaaagtaagataattatttaatcaataattccagttcagggtcatgagtggatggagcctatctcagcagctcagggactggtaaggtgggaaccaagcctagacaggatgccattctatcttagggggcactcacacacagccacattcactcagacacacccatgagcctaacacgcacatctttgggatgtgggagaaaacccactacccagagaaaacttatgcagatatggggagaaagtgccaactctacacacacagtggctcactgggaatagttcttttttttttttcccatcagcgttatgacaccatgttatttgagtatctgctatattccccatacaaaaatacattgatttttgagccaatacaataatccaatgctgagtttttattcctttgtatatttgccattatattcttattgaatgactttataatattcaatatgataaataatctgaatttgaaaatgagtttatctcaataaaatattactcattattccatatgttaagtttctaataagatttagtttgaaaagaggattctgcttgtttaaaagaaatatgaaaaatgtctggatcaaataatatatatgtatcctgcaactcaaggcagtatgaatctcatatggctccaggctgctcagtttctgaatttatcaacttgctggcttagaccactgtatacagcagatgcattgggcccaaactagattttatatatgggccactattccttcaggcttaagaacagtatttttatactgaggaatagcttatttatcatgaaaccatcatacatcaaaagaagtcacgttgccttaaacttatccagtacatgaaatttatcaccctcaaagttctagattatcagaatttaatatattagtttaaaatataaccagttgataaccaagaaataagtcaatggaaacctctttaattatctaagcagctcatcttgtttataataattgtataacttacagatacatactcatttatttttcaatcaaaatatattatattgaaagacttcagaagatttttttcttaatattaaccaacattacttatagttaggaacagagtgagccaaaaaggattctcaccactacagagaataaaactagcaaacctggggaaagatccattttccaaaacctgaactacactctatgatggtaacgtttcaagtatttataacacttaagtataagtcaagagttgattgaatgaggcctttcatgatgtttatgtagagtagtcaaaccagaattatttatgtatttgtttatttttaaaggctgtcatttgaaagttatcacagtataaaggtaaaggatacaccggagtttccattctagctccacattcctggctgtgtgaccttggataatttagttaaactaaacttcagttttcacttctgtaaaatgaaggaaatagtagaggttctattgtcatgaatttctagcaagaaatcaatgaataaatgaaatgatgaatgaatgttgcttagcatgttgcctggcacataaaaagctctcagtaaatattaactgtaattaaaaaatatctaaaagccggttgctttcttttggttatttttttaatatgacttgattttattcataacttactgactatattttcttcccttctggaatgatgttctattgaggtttctttttcttttattccagaatgttctctgagcaatctcttcatttctgcctcattcatcagataggattgtaggcgttcattttggtagttctgcatttggttttctgtcactgcttatgctgttttcttgttctaactcagtggtttaaaaagtaaaattcaagtaaggactaaacataagagaatttactgggactaatggttatcaaaattgggcataaagggatgttattaaaaataaatcacacagagggagaacagctgatgacagcagctgtgaaatggatgtacatggtgggaatcagtgagccccaaagaaacaaacaaaaaacactggagggccatgaaacttacatgatttacaagggaaacccaagctttatgaacagcctctgaagactacagaggccaagcaagtcacttctggatgaaaatttggataagacagcaatactgaaaggagttatgttccctgatcaaatgggagctacagataagaaaagaatgagaaataaaatgaaaatctttaccgagtttgatttctttattgtataacctgcactgaggggacaccatctctgggtataccactatagatacacttaccaaatgcttagtgattattgcaatagttagaagagaatatattttaagagccaaagttacaaatctatggacaagatgaattaatattagaacccatgttgagatatatagggcccaagtagtctatgacacaaaagtttgtgtttttatttaaatagaactctaaagacttagttgtttgaaatatatttaatgtagagaaacatttttttgaaaatttggtttactgtaaagatgaatggagatgtctaactttttgccttttttttctagatatggacccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttcaaatctctatgtaggaaaaatatcccacattcattcccattttactatgaactgtataaacttccaaaatcatcatgaaaagaaaaacatcaccctttctgctaattaagtgttcttgctttttttctagtaatgggtatttgaaaaataacaatatgcaagagtatgatcttacagtgaatatagccactaggtcaatatgataatttaatgtgagactttaaaattgagctttccttttatgctactattctctaaataacttctttatttgctatgattaaaatatcttttcatcaaatttgatataaatatactagatatggtaaatatatttatcatttaaaataacaattgaattgtacaataagcactatatcattgcccaatttttattttgataaaatctttttaagtgatatcatttcatgttaggctttttgtgctgcttaatattataattaataattcatatttttgtctttctcctctctgacaacttttatttttaatcggtgggcatgtgccaaattggtttgttatttatttataatgtaaaatgacaagggaattgaatatgtgaaataagatagattttctttcatatgacaaaaatttcttagtaatggggatgcttcttgcttacccttatagattcaagggttttagagaggttaggtcaaatgtcacacttctcatataacaacatgtggtaagtgcattaaatagactgttcattttttaaaaattcattttagttttgtgaagacatctgggcacatgcataaaaaacaggacaaaacaatatcaaaatttgtaaaagactccctattccgataaatcctatagtgtcaattaagtaaaaattctgaccaaacagatgtatttgtattctttcctaaaaactaaaacaggcaaacgtaataggaataaacagagaacgtttcaaagatacagaatttccattgaaaaaatcaaatgttctgtctgtaggactttatagaacattaaataatcttttcagtactgtccataaccagaaaccacataagctggatgctagactattgactagttatgacaaaaaattcacagtttgatctcaagggcatcagcgatcctgggctcaggtgatcctcccgccttggcctcccaaagtgttgggattacaggtgtgagccatcatgcctggccatcgtgccaacgtattgaagtggaaagaactaatgctgagcagagaatgggccatacctgggtggttttaagaggtgctgctataatgaaaaatcacaggctcacccaagaactaccgtggaatcagaacctctagggatatggccctagaatctgaattttaagccagttcctgaggtgcaattcagtttgagaactacagtcttaaggcaaaacctttctatcataccagagcttccaattgtcaggccctttgaatccaccctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaaaacaattttagatcttaattattttgttattaaaatgttgggggtgtttaagttgacattgagtcagatgtaggaactgatatacagtgaagttaaatcctttagggtaaactcattcagtggtagaggctgaactacagagcctaggcattctgacattccaccactgtgcttatcagcttgctccttgagcaaaccttttcctgcctttatgagaatatgcccattttatgggctctgtatctatgagatattttacctatgcttatgtacacatggtgtttatctttcaaagctggactatggaaaagcctaattttacaaacatgttagtaaaagattatgtaatctgaggtgattacgtttaaaatggcaatgataatgatgttaattccagtcctgtgaggtactgtttctgatctggaaagagcagttttcttttttaacagcttattttgtattttcataatccattttaaggtttggtattaatatagacatgagaaataaaatataactgttgccatgccaaatgtatatcaaaaagttgctaatagccatgactgctatttggttaactgtatttcactatttaaataaaatgatggaaaatggtgtgtctaggatctcattcataataatgaaagacaatagaaactattagcataggtatgatgctaatgaatggtaaattttcaatagagatccatcgaccagattgtttgaaaaatgtttcctgtgggtacgaaaaatgcacacaaacaaacacatgcatcaaaatgtccataattaagtttttagggaaaaataacaatatatgttggttaaggactttcacttaaatggcattatagatctttcagaaatgagagttgatttatacttcagtattttggttcccaaaggttgggacagtgggtggtagaggagaagtagagtaaatggaaggtatacatgtatgtgtgtgcatatgggcaactttaagcaccttgaatttaatgaacaaaaaatgtcattattctgtgtttatatatttttgtgtgaaacaagtacctttctctatcactggagtttacatggattttctcatgatatcttttgagaatctctttaaacactaaaatacatttttccaaatgaaaactcccataattctgctttattaatatctgaatgaatatttccattgatttgtccagaagaaggaactgagtactgtttagagagcaatctttttcatgataattggcagcaatgtttccctgctatcagaaagaaaactatagaaatacgaaactttagataaacatggagataaaaataatattatggagtccaactggtatctttgaggtgaggacaggctgagatggactccttggcttccttctgtccaaaaatttcctgtttccctatttcctacggttaccaccatggaacatgttaaaatctcagtagggactctgtttcaacttttcctgtcaaaacacagtgaaaaagcttaatggaaaaaaatgtccttcctatctccatgccaggcacagtgtaagatccacaaacttaaaagccaggaaaatattcttttatgtgccccaaagctgggcaagtgacctagtactacaaaaattcccaaataggcatgtgacctgactaatgtgtgctgtgagatgagtcaagaaaaatggaaccatctgtacttttattggacagtcaaataatttctttctgtccacccaaaaacataatttctatgttaagagtgatacaaggagacttttagaaagtctaatttttaaaatcagagatattaaaatatatgaaaagtataacctattaaacactggtggagataagcaaataggcttatgaaatcattattgctttaaaaatttgttacctactcattgtgtactaaggcttctctacgacatacagaagaggccggtgcggtggctcacgcctgtaatcccagcatttcgagaggctgaggcaggtggatcatgaggtcaggagttcaagaccagcctggccaagatggggaaaccccgtctctactgaaaatacaaaaaaaaaaaaaattagctgggcatggtggtgggcacctgtaatcccagctactctggaggctgaggcagagaactgcttgaaccttggaggcggaggttgcagcaagccaagattgccccactgcactccagcctgggtgacagagcaagactgtaaaaaaaaaaaaaaagaaaagaaaaaaagacatacagaaggaaatcagggaaaatgggaaaatgaagggaattaacaaattgcaataatctttaagaagtagagtatgaacaattttccttttctaggatgaaagctaccaacaactgaactcttagagtgagtgatggcagaaaaaaatagcaatcaagaataggggcatgttagtttttagacatgtttacaaaactctgccttttatttcttaaacccataggtcaaccacccatcatacctacattaccccatatgacaagtggatttgttgtatgtttcaagtttttaatcttggtgggaagggggagggcagagaagtatttattggtaaaatatcataataaaggttgagcctgtcaatgattgtacctaacaataataaatatgtgtaggaagtaagaacggcaaaaatgaagccgggtaggatactgtggatatggtgacagacaagtatctatacgaaatcctgagatatttgtcctccatttcataaattaaagtgccccctcttttgctttacagataaggaaactgaggtgcattataatagcaacagcagctgatgtgtagtagatccataccacaagccaggtacgatgtcaaacatttaaatgtatcatttaatttaattttcatagatctcctacaagacaagtgctattattttcattttacatacgagaaaactaaagctgacagagattaaataacttgtccaaggttgcatagtaactaagtgaaagagccaagatatgaactcagatctgtctgatttcaaaacccaggcccttaaacactaggccagtggttttttaaccctgattgcacattagaagcacctggcaagcttttaaaacctactgatactcagaccctaccccagaacaattaaatcagaatttcttgtacctgggccctgatgtgggtgtttgtttcaaagcctttctgggtgactgtaacatatagcttgggtaaagaagaattgttgggtgtctcccatggaggtcagtatatctgtgccaatatgtgaggtagtacaagactcaagtgtcctcagtctgtctgcagtggtttttcccttgccccatcatgttcactttgacatcttttttttattatgatttttggagaagtaatatacaagtgacaatttttttacaaagcattgtcacagcagaacatggtcataagtccatcaaagagaaacctgttcatatctatgtacaggctatgatgaatgaatacaaagaagactatgtttattactctcatccccaaagggaagtataaagctggccttaaaagctgttcataccaaagctaatcactaaaatttggaatggcttcctcctctcctttcacaaatgcaatagggtagccactggatctaaggggaaaagatccaattaccactctttacaatgctttttcacttaggatctcaagacgactgacagtcattcaaaacataaaagtaaagtgaaaatatctctagtagaagtgaaaagaaaatgtctgtagtaggaagaaggcctaaatttgtgtctatactctgccactttactgcaatgacttgaggccaaaagtaaagtgacagagtatagacacaaatttactgccatgacttgagccttgatttccttttctatatgtacttaagccatatcatccttagggcagtgatccaaaaaatgtggtccccatcagcatcatgtggaaacatatcagaagtgaaattatcagtccctaccctagactctgaatcagaaacttggtgaaggggcagtaatctgtgtcttaccaaacattgcaaataattctgaccacctccagctgactctgatgtatccacctccatggggttgttgtctaagaataaaaggagatggtccataaaattgttattttttttactatctactgaaatcagaaatttcaaaattctctcacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctcttcctcacctcacactttcgattattgcaatggtggaaaccatgataaataaaagcgcttatctagtggtttggttttcactaaaattacagacttctgtaacattatttggataccataaaacacaaaccaaattttaggagatgctttagggtgttttttcccctgccctcctgtcggaagccctctatctttttactgtaatttatctgatatagctaccaagatgcttgatacttttacatgcaagggtgctgaaaaacaaagagcgagggaatgggttgttaatgaaattctctgattgtaaaaagcactctggaatgatcaggtggtaaataataataagaggaaataacataaagtgcttaggtgctacagcgatagtcaccatataaatgcagaagagatcagacatgaatagaatttgcattttatgcagctgctgtgtgtgtatatagaatatacagtagctaatttttcaataatgctggtaaaatattgttcaaaatctattcttgctgtcttctcactttaaaaggcattatatagaaaaacacccatctgtcctagtgcaatggtgaatgtgtgcaaagagcctagaaaaagagcctctttgcatacgtgaaaaaaaagaactcaaataaaaggagataatgaagaagagacaatagtaacactattagaacagctatgcagacaagcacaaaggtgatctttgaaaaacatcagggataaataactctgttaatgtgtggcagagaaactacagttaagacatacagtaatataccaaaaatatagacatgcttttattttgtctactgggctattgtgatagtgatggttgtttttgaatagaaaggaagaagagagtgggaagtaggatttcgttgtttgttgttactgttgctgctcagtttagaacaacaacatcaactacacaccagacccgtccaacagttccacaaacaatgcttaccatgaatctgccctcaattttcttgttgttattttcccttaatacttattgataacccaatgcccattcattagatatgctaaatcctcgtccatggttactctcctttggaagagactgagaagatgctaagagggagttcctcttacacataagggaagagtctgtttaggaatctgagaaagcagaggccaggataaagagaccactagtcaatcaatactaagcaccgaagactgaatcacccaaagatacaattatctcccttcctttgttctgtctcttagtcaaataaaggattgtttgtagaaccttttctgttcctgatctctaaaaagcaggactggacttgcacatccaactataattcaaaatatctcacacttccaacttgaaagaagacataaactgtttcaaagaaactcagagagagcaaatgcatattcacaaaacttacacttattcctagaataggaaaatggagagagaactaaccacataagaaagggctaatcataataataatagtaataatgatgatatcaatcaatactttggattctagagaatgatttatcacaaaaattcacctgtattaagggagactccaggacaaggaggtcattaagctacatttccatcttcaggattcagccaaactcagactctccggaaagctgtaaatgctctcagaacagactttagtaatgagattggaatgaacactgggcctatggcgtaaaagcatctccctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttgtttttgtttttttttaattatttgaagagtcacttgtctggatgcttcgttctagtagaatttggctgatttttttcccaacaccttttagtggaatgcagtaacagatgcatggagggagaattggtcttaacagtatttttaggtttcatctgtgtcagagagagatctcttccctttattgatttcttgcatacactatccacactacagcttgaaacagctacaacagtgtttgaaaaattggttgttcctcactgttcaaaccatttttcaaaacagtcgttacaagcttcattttactttctgttataaggagggttttgtttgggttggtttcattttccttgtggcgtcatgctagcagagaaacacagtcaggaatatagcttttaaatgtggtatgattgggattataaccatatcagaatctatattgaaaatttattagattgagccatgtgcagttaaaaagaaagaagtcagaagtcttcgatatttttcacaaacatgaacaccatctcatgcaaacgttaaaattcaccaaacaaatgataccccactgttggaaagatattttctcatgtcaacaactcaggaaggagtggggagggaatgggacatatacatgtaaaatttttctctatatttttgataataactctctgtgaatatgttttactacctaggtaatgcttatatttgtaaaaacatatagttatatcagaaagtcaattttgaataaacctgagaatggcaaactataatttttaaaatactaaccttttagaactgttcattttcacttttatttccaggactcactatcttaaagagaagaataaaagttgaagatccttgggattaacagaaagggtggaaatagccaaatgtattcatatttttggccaggcgcagtggcttatgcctgtagtcccagcactttgagaggctgaggcaggcagatcacctaaggtcaggagctcgagaccagcctggccaacatggtgaaaccctctctctactaaaaatataaaaaattagccaggcatggtggtacacacctgtaatcccagttcgggaggctgaggcaggagaattgcttgaacccaggagatggaggttgcagtgagcaaagactgagccactacactccagcctgggtgacagagcaagattctgtctcaataaaataaaataaaatgacgttcatatttttaaaatacagcaatattcatttgtttaaaaaacaagattgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaccaagattgagagcacagttatatagtgacttttgatacatacacaataaaacttattgaattttcaaaaagtgagaaaaaaactactctgctttaaatttaaagtaataaataataatgaagacatatcaacattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcacgagatccttttagaggttctgacacaaataaagtaaaagtaaacctgttgtggcaaagttactaactagtctacactaactctcagtccttgctcaaagcaaaataatggagtttggggtgcaatctggtgaactcaatggtccaactgcataaaggcaaagaggaaagccaggcttgggcacttctgtagaaaatgaagattactggtttgaaggccagtcttctcactgcttcactgtatgtggtgactattgttaaattagatatccctattctgatgaaaaggcaatgtgctatttttggggtatacatgtttcaagctgtaaactgcaaagtgctgtataaaagtaaagtggtgttaatgcctcataagataaacatatagattgatgatggaggcatttaaaatgctttaattgcccactttaataaagcactaaataattataataaaaacaattcttcagaaaacttggtgggaaaaaggcctacaggatatgtttgttaagaataattagattttagttttggaggaaaaggtaggacaagtcacaggaggcactcgatgagaagtcaggaatgcctagtacataagccacacatattaagttgtagtttcttcaaaactgacaataacatgtcctccaaaaccaaagggaaaatcaaaggatgttgcctatacttatgtaccttttgctactggagatctagtcaatctatagccttggattcatagttctataacatgacaacatagcaaaatctcaccaacactttgttttaaagaaattggcagctgggtgcggtggctcaagcctgtaatccatgaactttgggaggccaaggtgggcggatcacaaggtcaggaatttgagaccagcctggccaacatagtgaaaccccgtcgctactaaaaatacaaaaaagtagctgggtgtggcggtggatacctgtaatcctggctacttgggaggcagaggcaagagaatcacttgaacccaggaggcggagcttgcagtgagccgagatcgcaccattgcactccaacccaggcaacagtccgtgactccatcaaagaaagaaagaaagaaaaggaaggaaggaaggaaggaaggaaggaaggaaggaaggaaggaaggaaggaataaattggctatgcctccaagtgaattatactataaacttctttcccattaccaataatgtaaatatataaccaggcacaagcatgtggaaatggagaaaggatgaacgttagtcttagaaactttggtttgtatcccatttccaccttttaacaagtcatttagcctctctaggtcaagattttcttacctattaaatgaagataatggtacccatctcacaaaattgttttaagaattaaatgtaaaatgcttggcacagagaggtcactcaatacatggcagccaaatcaccacatgcagtaaaacccagataaaatatattcagccaggactgttgctctgtgagtaggtctggtatccatgctacaaaatctattaagcctaaataatttggtcattttagcaatactctttagagattttttaatgacatttcccaaaggtcaagctagcttatggttatgtggaactgctgcatttataagagagtttagtgggttcataaaataagtcttgctccccaaatccggatcataaagaccttctatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaaaaaagattcaaaatctgactctaaagcaataggtaaagaaatattttaaaatgcttatctgtaggaagaaaagcagtaaagcagaattcctaggaattgagaaacacttaggaagaaaatgcttaagtagtacgatccaaggtgaggctagctgcagaaaatacaaatatttatgggttaaatcaggactgaggaaaatataaagccaaatatgggcagctctgagggggaaaaaataggcagcttggtactcaactgtcatcacaattcatttgtgtttcacgtcccactgtttgtgacattaacagaattttgaatttagcaatggactatttttgtattgtgaatctctgcagccattttccatatgtagctaccactgtaactagcaataacagccttttgagctttaaaatgcttccaattaataagattcaaaataggggtcacctaagagttttccaagttaattccctttgtctactctttgaagcagagtggtattcctgctattcatttgcattgaggccaaattatttgaccatttcagtaagatatccttaggtagcttttgcttttattgtcattttccaaaggattaagttagttttagatttttgaactgcattttcatttaactaaaataactaaagcaatctttttatgagggtatttaaatagatcaaatttataccaagttcctactgtgtgtcaaacattagcaaagcaatttaaaatgttattatttatatatcaatacatacaaatcatatgtgttatatattaatgagcttatagccattatacacaggacttttatgtgttattattgttgtggttatttctgttgttcgcaggtatcagttatcaagtacctattatgttccaagaactctaccaaggactatacacactcaccatgtaatgaagatattattggtttattttccatttgaagatttagtcacaaaaagtaacttgtccatgagcatataatttgtgcattctcttaaaatcacttaaacttccacgtaacacctggattgacgtatgctttttcttacaaaatatacttcaattcaataaagattctttagtcacctactatgtggcacctgctaggatagttatctttgtttgctattatgctaaatcacagatctgaccattagaatctcttccttcctgaaaataccctctttaggtaaaactgtatttcttatcattttccatcactgattgaataaagaaaggtggcactatctggaaaacataagagcgttggatttacaagtttcttttaataaaacaaaccaagttaatcacaaattgttgcaacaaaatatgtgacatgaagggcatttaaggcacatttagacattatttctatctagaaacagaaatttagtccacataatgtcatttatctactgagctaaatcgtattacaattttcatctataaaatccagattcttaatgtgtgttggaaagataatatctctgacccgctctcagtaagaaatgtgttttgaattgttttgttagtaataataatggagttgtactggacaaaatatattttcagcaagtttctctggtaataaaaataactataatagtagtaataatactagtaatcaccaataaataatagatagcatttattgaactctactatgtgccaggtactgtgattagcactttacatgtattatcttattaatttctcaaaatattacatgaggtaagtaccgtaaatccaatttaacagaaaagcacattgagatatagaaatccaataatttggtaaagatcacacagatagaaaagaggtacaagtcaggattggaacccaaggaatctgactctcgtatctatctactctaggtgggggatatagcaggtgctatggtgtttgttcaagagaatactccatttgtgttgttttatctaccttattagggttggggcccatttggtctgtaagccaaatctgaagacagctgaaatgagttaaggtttgaattagtgctattcacactatctgccaattaaaatgctcccttctgagaagctgtagccagttggcataaccttaggacataatacatgctcaaaaaagtatctgatgaatgttaacaatggtttctctaagtggtgattttactttctttaaaaaatactttttcctattgtctgaaatattttcaacatgggcacattacttaggtgatcaaggggaaattcaggactttacttaaaaaatgtttttgttttgttttacaattaggttgttagtctcagttaaaacataactcctgctgggaagcctttcctgttgctgtactctctgaccttttgaaggacagtactccttactctgtctgcctcagaaccttatgaaggccacatactattgttaattatcagtcttctctgctttatgtgaagtcccttgaagattgaccccattacttatctacctcttagagctctaagcatcttgagtgcctaccactcagttcaatgaaaaaacccagaacacacatacaccagaacaagcacaaaagatgaaaaagaattattttagggttgacaatgcacactcttggtatttgcagatgacttgtttctccccttacattatgtgcaggtccccatggaaagaagtttcccacaagaagtgtcttgaatttactggtctcttctctggaggattttacaaatgcatcaaggaatacacacacacacacatacatacacattatgaaataatatgaggataattagaagtaatggggaacacaggaggcaatttctaaaaaatgaagcatattttttatatatataatgtatatatgtatacctgtatataatgtatatatgtatacctgtatatataatgtatatatgtatacctgtatatataatgtatatatgtatacctgtatatataatgtatatatgtatacattatatataatgtatatataatgtatatacacatacatgtatgtatatatatacacacacgtatatatatatatatatatacacacacacttttttttttgagacagagtttcgctttgttccccaggctggagtgcaatggagcgatctcagctcactgcaacctccgcctcccgagttcaagcgattctcctgcttcagccacccaagtagctttgattacaggcatgtgctaccacgcccagctaattttgcatttttaatagagacggggttttgccatgatggccaggctggtctcaaactcctgacctcaggtgatctgcccgccttggccttccaaagtgctgagattacaggcgtgagctaccacacccagccacatttatattttatattaagtaattttgttcctttcctaccccattataatataaacttcatgaaagtagaaactttattttattcactacagtatccctagtccataaaagaaggcatggcattacatcctcaataaatatatgtcgaaaagaaggaaaaaggtatagatgtttccactgtatttcttatatttttctggaaacaaaggggaaaggtgttcccaaaaggtttccaggaaaacttcaatcaccaatgaaactgcaagctcttgtcatgttcctcagaccactacctaattaattcctttatgtgcaatacatcctttctagcctgttgatactcaatttctggcgctgctgtaacttgtggagcaaagagtgccacgtgagaggtgcttgggccccttcatactgtgcctcacctgcgaactggggaggccactgccatttaggctccagcatcttttacaggccagctgagccaccagaagggaaggggagaaagagacatgcaagttctcagaatgtctggtatattcactcacacacatttctcttctcttctcaaaaaggatcctggcaacaaatcactgattaatgatgagagaaatggaatcaggaggaccccatgataccctctcatcctagttttgggagataaaatctcccactgtggggaggaggaagaccctacagggttttcttatgttttgcagcttccaaattgtagtagggtcctattctataaaattgctaccaacaactgtatacttagtgatataataccatatggaaccttgagttttacttaaagagtagattatgtggcaattcatagttatcctagtatggataagaaaatatcctagtaataacataattattctagttatgagtttttttcagacaagaaactcttttattcatctttttatctctagtgcccagactcaacatatgactttgtatatagtagttcttaataaatgatagcttaaaaattaaataatatttttaaaatggtgagatatggcttaaaggggttcaaacaaattcagagttttgtctaatctaggtgtttctagatttatgagcaggcaatcacatattattgagtatgtattagtgttttagttagtgttaatacagtataataaaccctcattgattgttgtagagaaatcctactattttacactcatatactagaaatgtttaaagtcacaattttaaaatagtggacttcaaactttattatgcacaactaacctgggcagtttcctaaactgcagatccaggctacattctcagagcttctgatttagaaattctggaatggggttcaggaatctccattttaacaggtgctctagataatcctgatataggtaatccctaggtaatcctgatacagttggtccttggactacttaccatggactaggctacaaggtaatataataataaatctatacagttcaccttttcaatacgaagagaagagactagcctattaaatgtgacttaactatcaaaattacccgtgaaaagaataggcaatttgctaagacttctcaaaatgaaccaagggaggacataagggcgagaaatattaaatttcaagccagaaatgactctttttaaaacttcaaagagactgacaatctgcttaaagtaaaagtggaagaagaatggcagcagtacagaagtgttttatgaacaatttaggaaagcaacattgattcaagaggtttatttgataacatgttttaatggttattataaaagtgaatgccttctaatctttgatttgctgctaaaatatatatgtatttatttacatgaaattttttttttaaattccccccttaactccctactttccacacatttttagcttgccaacattactgcgttaatggtgtcctttttttctctctctagaaacacatgccctgggattaaaaggggattactttggtctacttccacatccatgtcccagggaaggtactgcttctgcttccgacctgacctttaggtatctgcagccttcaattctttacagtgggagttgctttagcattgatttcttggaaaactaagagctgttttcaaaagccattttcaagacaaataatgaaaattattttcttatgcttatggatgttacaaactgtgtaacaagcttttctctttaactttgctgcaagaaagtttaaaggcaactgtatagcacttcactgaatatagttttatgctgacctcacttctaactccatttttatatcctttcctttattgttttatttttcttacctatttctaattcatgtattttgctgcaatcatgtatttatgtttattttttcattgtcagccattttaattcccttattggtgcaataaatagtaaataagacaaataaacaaaacaaaaacatatgtatgtatgtgtatttggtatttacatcgcatgtactcaaaataaaaaataaaaactaaccacctaaaataattgacatatttcattattctttgggctatagattcacttgactgcagcacttccatttagggagatataaaattaaaataccaccatgaaaaaatccatatgaaatttgacataggtattttcagccccaggtcattaattcagttctgactgacatctttcagttctgttttaaaatttttgtgttcagtctttcgattacacacacaaaaaagttttggcttaatcagcctaataaagtgtatatttctgaaaacatttttatgtaaacaaatatagaagtatacatgatacatacacatacattttttacttagagtcttcaaaccaaatatttcagtcctttgcttccagtattattttcttttaagtaaatacttttcattaagcaacaaagagtgatagtcatctcaacaccaaaaacttgtattcaggctaagtttagtctactttgcatattttcctctgagaatgatccagccagtctcagtctgattctagtaaaactcaggtaatgtggaagaactctaattgagtattagacattttaacaattatattcatattgatatgtccttatacgaccactctaggtgaaatattactatgcttgggacttaaatatgatttttgttcttttattaatttctgaatctcatatccttccagataccaaaggaatacagtaccacctgggaataatgtcaattttcactttaaaaaaatattttgttgcttttcccctcagcatgggcaaccaatagctgattcatactttcattacatcacagttggattacagaagggctctttagtctggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatgtcactcaactatactttgccattcacttaccatacgtcaaaaaggtggaataatactattcttacatagaggactaataagatatacttagcaaaagtaggtggttgcaaaacatttttttaaaaatcagagtgctgtatttttaaaatcttgcatagaactctggttcaatttttgagtccttccaatttctcataactctgtggtattcataataaagcaggcagatggttaagtctctgaacatatgctttaaatgccccctttgctatttctaaataatggaccaaattttgccctcaaatagtcacaggaaactttaaggaggctgcctcttgaaatctgaggacagaatgtgatccagtgggaattaaacctttaaaaaatatattttctaaactttcttatgagctctattccctataccaagacaaattacattttttaataaaataggatatagtaagagaaaaatcctaaccaatacaatattacttggctcaaggaatagattagaaggcaacatatgttttatttatttatattttaaaattctgattttctaaaacatgagagtcatctgattaatttctgtgtgattaccagattttccatttttattattattcctattactagtatcatgtagatgttatattgttaaaacatcttgcaattattaattagttaatttagtttaaattatgattatgcctttgttttaaatcaatgtttttcatagttattaaaagccaaaagcactatttttccagtcacttactttcatttcaaaaacagtttgttgtcgatgaaagcgcattttccaggttatcacagaatatgcaattcatctgcaatggatatatatattctggtaatgttgctcacataacctagctgtacttgtaagagtatctctgtttcttaatgtctatattttatacatggaattaaccttcatttgcacactcatatttctatgtatttaaatttattcctgaaagacctctgaactagtctctcctgtcttacgatgtccacaaaacttagcagtctgattaacattacagataaaaagaccacacaattgacaataaggacactttagttattatagacgtctgaagtttaagtattccaaaactataatgtccctttagaaattctcaataaggattagcttggtcctaatgaaaacagtgtttacttttaaaaataaatgcaatagttgtacccaaatatgttcgaaacactgtatgacgtgtcataatcaacaatgttgaaaataactaaagatctttaaatcaagtgataattttacacatatatccacaaatatctgaacaaaatttataattactattgggacaaaacattaacatattcttctgctaataaagacaaacaactttgagaaaatcctctctcattctcacgtctctaactttcacaataaatgcagcactgaaactaaatttccaactcagaaatacgctgagctccaataaacaagttgattttaaaaactcaccagactaacagttatgctttttcccttatctttcctttgctttcccttgttctttcactttccatgcacacacaatcacacttacctgcacaagtctgaaacatcagtctatgtattttttttgaaatgtactctgtaccgatgcatttttctgtgtttctttctaaccctcgagaatgttaagaatttaggaagagagccacagcttaagagtgcaattatttgccagtaaatactcaatttgcttgtcctgtgatttttcttctaacttgcatattcaataatccgtccctgactgcgtcacgagcacaaaaagtcttttctccaaaggagaagactttcgccaatcaaccttcagccatgccagggcacagcttgtcagggtgatttgttagctttaattaataattcctcacactggccattttcacaaataatgcagtgaggctgggaggctagattgctatgattcagacagataaaactacagtggaaaggggatggggaggggtgtgggggaattcagatgccgtttataaacacctctaatcatactctttcagtttacaatatagaggacatctcagttgaattaccacgttatgtccaccaatttgtattcagatggaaaccatatgttcctccactttatctgctagggactccctggtgccaacacagtcattgggcagacaacattcacaaaagaggtctctagcctctggattgcaaaagtttactgcagggtgaagttgagaaatcagacatatactgcacttctcagtgagcttgggtaacagtctggaaacacagaagtatgagttatgagtgtcagattttctcttatcctgctatgtgatactgggcatttcatttagccttaaaaaaaaaatctcatacctcatcctcaaatcagtttgcaacaatgactgatttgttcatgcattctatgaacatttattgactcccaaatatatgctacacactgtattaaatgctgagaattttgcttgaaagtaagacttttccatttaactgacaatccatgggcttgaacaaagccaccaaacagatagtgtgcaaataaaaataaggatttctaacagtttctgtgtggctcaaccaaataatcagtaattgacaacacacttgagtccattatgcaaaagtaatgctcggggtaaaaaagaatatacagagattaaaaaatatgtttttcaaagattaaaaaatttccctcaaagtgactagagcactaagaaacatattaatatgttcataaacaatttccaaagattcacaatcactttaggaacatacaaataaaaaaattttattaatgtccttaatcttatataagaatatatgcctgtgtttgagactgcaaatttattaatttattggatacatatttattgagcatctactctatttcaggaactgaataatattggagataagtaaagcacagcctcgttattcaagaagctcacaatttagtcaccagactctaaaagagaaaacacacatctcaactgaaaactgtaatacaatatagccagagcaatgacacaaatatacataaacatgtaggatgggcctcctagaagtgatgcatcaactatttgtaaaggttgggtagaagtaccagtggtgagaagaacattctagggagaggcaaacctttgaaccctttctcaaactgttactagaagcagagcaccagttctagaaaagatgggatttaatacatgacaatttcagataaatgtttcagatggtaaatattgcaggatttaaaaataaacttattaagaaacaaatgttccccaaaactataatgtcttgatatcatcaaaaaagcatgcagcatctctagcactggcacatagtaacatacatgtctttctcactttgtgtgtttcagttctctgaggcaaacatgaaacatgcttgacacacactgcctttctgtgttttcttgcctatttatcttcttttactatgggcaggcttctactgcttctgttttcactgtaccataagataaatcatatttgcatgactgttaaaggaaggggaaaaatctgtgtccattttgtggtcacacatctacttctagtcagatagcacatgctatatgggactaagagtgcaaatgttaaatgagaaaggaaataatactcctaaacccccaaaaagctctttcatagatagtaaatactcctagaaactatacagaattcttggtgttatttaacattttgctttatattatatttaacagtgtaaggcaacagccagaatactatttaccatagttcagtaacatctagccatttaaagaatttacaaagtttattaattcattaaatatgtatgtattgagctcctactatatactgagcacttatcagtaaatgtttgatttttattcccacaatgcttacacataataatagttaacattcattgagtgctgactatatgctagggactaatctaaggactttacatatagtatctcatttaattcccacagtaacattatatgttaggtactattaccacctccatttagtatattatgaaactcacaagtagagaagctagatatacactatgtgaattcattctacacaatgagaccagggcaactaatgtccaccaaaaatcagatttattactttatagttacacagtcacaagtaatgtttatgttgtgaaaattaaagaaaataagtccgggcacggtggctcaagactgtattcccagcactttgggaggctgagctgggtggatcacctgaagtcaggagttcgagaccagcctggccaacatggtgaaatcctgtctctaataaaaatacaaaaactagatggggtggtggcagaaagctgtaatcccatctacttggggggctgaggtaggagaatcgcctgaacctgggagatggaggttccagtgagccgagatcatgccactgcactctggcctgggtgacagagccagactccatctcaaaaaaaaagaaaaaaaaaaaagaaagaaaatgatatgcttaatgtgcatagcacaaaatctagcccagaataggtgtaaaatatatggcatttgaagtattcagagttaaagattaccacatacaactaagacttactgtttctggaccaaatgaccatatattattgaagcctatcttagacaataaatgtaaataaatcttagctaaagcaaattagccttggtagtctgggagggttttcctttgaagatgttaataatatagttgaactggttgtgtttaagaaagcagagctgacagacaaaatagagatagatgacacaggaactcaccagttaataatagaaaaaattcttgtttttccaagtgattaatacaatattacattgtatttaatgtagatgaaaaagcttatttggtactcactggggaagccaccactcagtataatcatatgctcttttcaaataatcccatgctgctaactttacagctaactgccagcatttgccaactccgggcactctgatgccctctccacattctttcttctctcttgacattgactaagtccagccacccataattcttgacctaaactatggcacaaatatccatgaaacagaacatttatttttggtgataaagctggttctagatgaaatggtggtatttctttatggaggagctgcaaggaggctctcttcatttgcttgtgtgtgtaagtaaagtttctgatttgggataaaggactgcctggaccctcaattattggtgtttattctatggatattggctgagatattttgtatgggaaaaccagcagatgagttaatgagcatccgtctgagccatactaacctagtggcacctcctgggaagccagggcgttctagaatctgtttatttctcaaatgaaaatcctaattcatagaagttaaaagtatagaagacaacttcacgtactctttcttcatgatacctggattggttacaacttagtaaaattttagcctgtttggtccctccttccttactggctgtctgagtctctagccttatataggaaaaccttgtcttctaattgaaaatgatgacaaacagaagttatgacagacacatttcaaagtagatgctatttttcccaaataaatttcacatacattctaattcctaaacttatatattttcacatactttatataaatacctgacaccttaaaatgttttacttagtgagacctagataatgaaggaataaaaaggtgacttaatcccagtttttctaaacaagaagtttagaactcacgtattttaaacttgttaagtgatgatcaatataatgggctgtatatttggttgagagttaaaaatctaaagttttctcagagtactttaaggcattgctttctcagtggaaatcttcgaccttcacattctcaaaaggagaaaaatgtttcttgtcagaaaactagtcatggctagtccataagaagaagtccaagattgtatcagcttccctgtgaccttgctatgagatttgctacaagtaatttaatgcttttctatgtctcagtttactttttatctatgatacctcaatgatattattaagataatgtggatcaagtgttttgatcattgcatagaacatatgcatagaacatagaatatagaaatccccaaatataagaatgaaaacttaaattgttagaatgacactaactctgctacaaccttaaatagcatatatagtacctcagtgtctccatttttttcagctataaaatgagaatagtcatctttatgtttttcattaaacagtatattggaataaatagagattattacaaaatctgttgaaagatttcaacaaaatgtcatacatgcaagtgaggtgatgaatatattaattggcttgattaaatatttctaaaatgcatacacagatcaaaatatcacattgtaccccataaaaatacataattatttttcaattaaaaataaataaataaaattaaaatgtaatcaaacctctgaagctgattttcaaatatattagaggaattgattttaaaatatcaaagcgtaagaagtaaatgttttcaagcatattcagacacttatgaaggaagactattaaaagacagggagcaggactgccttttctttgtgtggctggctgcattttatgatggattcaaaaccccagtaatgagaaaatataatcagaaaaagtgatttttagcaggctgttgaatgacacataaaataaaatgtattcattaatgagtcagcaaaaatgttatgcatgagctttcagagccagaatttttaagcagctttttcatacttggtacagccatgttcctgaagtatcctctcacaacccccttctacctctctctctctctctttttttttttttttgtcctgtactgccaggttggaataatgaccaaagggaggggcaaaacaaacagatatgctcactgtggcagaagtcactccaaagatcaaagactcgattcagccgtggctgccaaaatcagaaccacagtgggtgctcatcagcacggtgccctcagaaccacatgggctacccttgataggttagcagcttggggtgcaggccccgcatcctgcttagaaccacctgctgagaactggatgtgcacattaccttacccactcacaacatttgatttcaactcaattctgctctagtattatgtttattgaatgacggaagtctaacagacactgtaaaaatccaatttcacatcttatagtacccaaaagggaactgtgattttcctatatcagtgagcaaaatcttgagcaattagtaaacaagatcaccaatttctagtatttctatgagatatatttctttagttttctgtaaggagaaaataatatattggtaccttagtatccagcaatcttatattcatttatagggttatctcaagttaacatagtcaaaaacccagaagagggaaaatagagcccttgggaaatgaaaagaaatgccataaggtacacgctgttgcccaaatacatcattacttaccaaggagactttaatttggaaccaatttattcttctttaatacacagtaacaccagtaatctggaccctccattcatattacatgggaagaaaacactttcggaagaaagtacaatgatatctgtaagaaatgatggctctatctcagaatgaagaggagacagaggaggtgagggagaaataaaagtatgcaaagctaagaactatgtacagcttgcaaacatctctattattgagtcctgcagaaatcattgtggtaaagctctgcacaaaaaatagtgttcataattattatgggtttaattgtgccctcccaaaattcatatgttaaatttctaaccccaagtatctcagaaaatgaccatatttggaaatagggtccctaattaagatgcagtcgtaatggagtaaggtggttctctactcaagtatgacttatgcctgtagagaaaggggaaatttggacatgggcacacatacactgggagaatgctatattaaagatgaaggcagaaatcagggagatgccttacaggtcaaggaattccaacgattgccataaactccagaaactaagcaagaggcatgaaacagattccctcccacaaccctcataaggaaccatcccttctaatagcttgatctcagacttcttgcttccagaactgtgatccaataaatctctgttgtttaaacaacccaatttatgatattctattatggcagccctaggaaactaatacaataatgattatcaggaaatcatcatgtaaagactaaatcaagttcagaatatattgtttaagaaggttgaaaaatataagattcattgcagaaaacgaatcaatatgcttttgcagaaataaagcattcagtgtttgagtggcacaaatatcgaaacaataaatgatttctttacatggaacatatggttttcaatttttcctaatccaatgagatgttgccatctttactaaaaagacaaactgaaatatactctacagaacacgtcaaagaaagagtccccaacctccaagaagcattttgactaagaaggaagataaatatcaacttatttttatttgtttgtttaaaatacacagcctaatatggatgaaacggttacaaagagaagttctgggtaaagaagaggttgtctacttagaagaaaactactaataaatggggtttgaatctacataaaaattaaaaggcattcatccagatgagaagttaaagagaattctaagtatgaagaatggagaaacatgagaggactgaacaaagcaagagtaagagaaggtaggggcagaaacaacagcagagggaatatgagaaggctagctggtattgagagtgttatcaatctgaaatgggcacagaaacggataaaaaagcctgtagacaggtaagaaagacaagaaacagtaacattcccatatttaaacaagaagttgaaaacatctagtgcaagaattaagctctaatctttaaaacaggtgctcttaaatgcttttgcatgaataagagactgtaccttgatttttcttcaaaaggattcaatagtgggatggaaatgtgtgtgtgtgtgtgtgtgtgtgtgtgtgtgtgtgtgtgtataagctaagctgttactgcaggtaggtcaatgaagaaatacttcatggaacaggaagttatagcgttatacaatgtgttccctggagaagtttaaaaaaacacacacaaaatagccctatgaagtttgtttgctctgttaaatagctttaaaattctacccctactaattgttcttaacattttatttcagccaattatcaatttaatctgggagaagaaagatctacttgactttctgacagccaagtcaatccaactagaaaattcaaaccctacaagaaaactgctttgcaacatttttaactgacaacagaaatccatgataacataatcacctttttctttctttcccaaactcattctctctaaagaaaataaacaatggtacaaagatacttggatgaaatgaaaaagtgaagagagctattccctctttatggtaataggatgttcttgttcaagatggttaaaaatgtaacctgagttctttttcaattctctatagaagttggagatggtcttgtctacatatctaaagtaactgaattatatcagcaaatataagaattacagcttaatttcacccattttctatcttaaataattcataaattaattagtctctttattttattcattggaaaaatgttggcttagatgatgatattcaagtagggacccaaaatgttaaaaacgaagataaggaataggttttgcatagatactaccttttttcccactgatttctatggattttctattacagaaataacttctgcagagcactagtacttctgcagaacagagtaggatattctcaaaactgggatggtgataaaatgaataaaatcagcatcaagtgatgagaagcagatgagtaaaggaatatgccacagcactaaaataaaatgggcccttaattaaaagtccttgattaaattttaccttatgaagagaaatattgaaaagaaaaaggaagaaggagagatgaagggaggaaagatggaaggacagaagaaaggaagtgagggagaaaggaaggaagggaggaaggaaacagaaagggaggagggagggagaaaggagaaaaaagtgagttaaaaagcaagaaagaaggaaagaaaaaaaaggtaaagccattatagaggtattttctcatcctttccccactggctggccctctaatcttccttctctgcttcccaccccaatccaaatgtctgggacacaagtaggatagttgggaaaaaggggaaaaaaggaaaatttctttctccagctgatgctcactttggtaccaatagctctaactcaacagttccaagtgtttttaatctcatgtggtcctttgagaataaatgaaacttatcaaccttctctccaaggaaggggtggggagaaagaaaaagcatatttacaaatacatataaagtatacatttagataaaatataaagtatatttgcatacattttcaaagggcttatataaactctgaaattcatccctgcaccatctaattatccattagcttaatatgaaaaaccattggctctagaatctggaccaagccataataaatggttggggatagggatttggagaaatggaaatgagatacaaaacaaaccgagcaaaaacacacacacattaaaaataaaaaggtgttccttctctccaagtcaacccttaaggatctggctcttcattgttcctggaatttagatcaataaaaaatatgacttgaccaataactatttaattaataaaaatagataaaattatatagcaatatatataatattgtagcaattcttcatgttttaatcattaattctacattactccctgttaactgtctttgatagtgcactaatatataatactgccctgattttgaacattagtctaatacttacaataacattgaaaaccaacaccatttaatattgtgattagcaactcatcagacatataggaaattacaaggagactctgcaacagatacaacaaagcaaataaacaataataaactaatttcaatgttttaatggctatatgtaagaggaaacagaccttgccttaactgtactaatgggaattgtttatatttgtttaaaacataataatgtttcgcatagtaattcataatcttcaaatgccttaaagtatatttagctcatctgatgtgactatcaactctggaaagtaaataggagagatatcattatccttttttcataagcgagggaagagaggctacaaacgattaaatgacttcattaatatcacaaatctaacatgtggtagagcaaaggctagaactcacaggttctgatacccagtaattttgctaccatgctacacagtactcaaaaagtattcattacacatagcttgcttaggcacatgtgttgtcttactttggaaatgaggacaatagaatacaccctcaaatgagttgatacccatagcacttattctttcacgataaaattttattttggcacacagtaaaacagaaagtatattagctatttaacaggtgcaaatagatatttttgaacgtgtactgcatatcttatggatgatgtttgcatgtagtacgtgtccatgtgtggggactagtgtacgtttaatcattttgttagaaaaataataccgttgagttaagcctgtgttttattgttaatcatgcatttagtaacagcacaagttgacaaatcacttataattgctacatattatagcagcacaattcacaattgcaaaatcatggagccaacccaaatgcccatcaatcaatgagtggataaagaaactgtggtgtgcatatatatattatatacacacactatcatacatatatactatatacatactattccatcatatatatatgcatatatctgatgcatatgtatctatttgcacctggtaaatagataatatactttcaaatatatctatttgcacctgttaaatagctaatatactttgttttactgtgtgccaaaatgcatatatatatatatatatatatatatatatatatatatatatataatggaatactatgcagccataaaaaggaatgaattaacagcatttgcagtgacctggatgagattggagactattattctaagtgaagtaactccagaatggaaaaccaaaaattgtatgttctcctgatatgtgggagctaagctatgagggtgcaaaggcataggaatgatgcaatgggctaggcatggtggctcagacctgtaatcccagaactttgggaggacgaggtgggtggatcacttgaggtcaggagtttgagaccagcctggcccacatggtgaaaccctgtctctaataaaaatacaaaaattagctgggcatggtggtgtgcacccgtaatcctaggtgctccagaggctgaggcaggagaatcactttaacctggaaggcagaggctgcagtgagctgagatcatgacactgcactccagcctgggcaacagagcaagactccatctcaaaaaaacaagaatgatgcaatggactttggggtcttggaggaaagagtgggaaaggggcgagggatagaagactgcaaatatggtgcagtgtatgctgcttgggtgatgggtacaccaaaactcacaaatcgccactaaagaacttactcgtatagatcacctgaggtcaggagttcaagaccagcctggccaacatggtgaaaccctgtctgtagtaaaaatacaaaaaattagctgggtttggtggtgggtgcctgtaatcccacctactcaggaggctgaggcaggaaaatcacttgaacccaggaggcagtagctgcagtgagctcagtgagctgagattatgccattgcactccagcctgggcaacaagagcaaaactccatcttaaaaaaaaaaaaaggaacttattcatgtaaccaaataccacctgtaccccaataacttatggaaaaaaaaaagaatccacttcatgtagtaatatatgataagcacttagtaaatgccaattgttatgttcttgcctgggcaacttttggttgtcaactgagtagaaaaaagcgccatcttttagaaatctgtaattccttcttatctgtatgttaccttcattttcataaaaggtaagcagtaaagtgtattgtatcatacagtgatgaattttggaaattatgcataacattttaattatagcttgaatatcctttatctacaatatctgggagcagaagtatttaggagtttaggcttttttcggattttggaatatttgcattatatacttaccagttgagtacccctaatccaagagtctgaaatctgaaatactacaatgagcatttcctttgctcatcatgtccatgttcaaaacatttcagattttggagcatttcagatttcagattttcggattagggatgctcagcctgtattttaaatatgaaagacatgcacttgttaaggacttttgcagagattttactttgcaattatgagtcagcccatatatgacttctgttacgcaattgcatatttctcagaactctattttttttcatttgtattacttaaatgtttacttaactgggaaatagaagatttgttttttgttaaagtgcaaataaatgacaaaacaaacctaaataaaaaattagttgatttaaatactcaaaaaacccaaaatgcttcatgaataacatagtagaacatactttgagaaaaaaatataaacatacatatatctgacttcaactatcttgttagttgatttgtgattacttaattagatttattaaataactaaaaactgacttacaaatttataagcatatattcaggtttctgttgtaattaaagtaaaaaaaatagttaaaaatttacaatcttattgtccttatctttcctgtttttacttgggaaattatccttcttacttaaaaattttacttcctgtttttatctctgaaatatatagtctaatatgaaaatacacaagatggcagattgcaggggtgagctcatttcttccttaaggaaatgatataatagaaattataatctagtggatttacctgtactatatttctctcttaatattcaaagcaacccttccatcccaaataccagagccaaccttgaacagaattccaaagtgtggatgaaatttacctccagttcctcttccttatcccctctttgtccacgtttccttttgaccttttggcccttcctttgaccttatctaaagatgtatttctggtgttagaaagtgttagaactttcctcttcattttcagcttaaactgaagtctttatttaacttggattcctaactattgcatccttagcccatattaccaacctatgaattgaaatgttgccatctatctgaccaacctaataatgtcttgcatcctgctctcaataggtcacactctcttagataccagtgaaagacttgagatttttctgtttcctgcatttatctcagccttccatgtgaatcacctgtattaaaattttagtaatccccactttcggaggctgaggcaggcagattgcctgaggtcaggagttcgtgaccagcctggccaacatggtgaaaccccgtctctactaaaaatacaaaaaagtaaccgggcatggtggcacacacctgtagtcccagctacctgggaggctgaggcaggagaatcgcttgaacctgggagatggaggtgcagtgagccgagattaggccactgcaccccagcctgggtaacagagtgagactccgtctcaaaaaaataaaataaaataaaaaataaattagtaatctcatttctgattcacttgatctgggcttacttccttttcccagctgggctctctctatggttctagtatgctttgtagtgattaaaaggattaggataaataaaaccactgccataaaccaaaaaatttctggtctacctcaagccctaatggtcaacttggttttccctcgcccctagttattctgtttatcaaacagaaaataaatactctttaccaagtttcataacatatatattaaaaaaatctactaatagcatttagaaggtgagaattcatactgaatcttctacttctagatcaaaagcactagaatactcagagtactctagaaatgtatgatggaggtaggtgactcattcttttagaattcatctgtgggaggcaaaataattgcaccccaaaatgcccactgcctaaagcccagaacctgtggtacatggcaaaatgttatgttacatgaaaaagcgactctgtaaatgtaatgaaggttgttaacactaaaacagggagagtatcctagattatccaagctggcccagtctaatcatcttaaaagcagagaacttttttggctggaatttggaaaagaggtgtggtagaaggggaaatttgaaagatgtcaagtgtaataatgattcaaggtgctgctgctggctctgacatatagggacagcacacatgcaaggatctaaagatggttcccagctgatagcaaggaaatggagatcttagtcccacaaccatgaggaactgaataagcatgaaagtggattttttttcagagtttcctccagttaagaatccagccgacaccttgattttggccttgtaaagcctacagcagagaaactggtagagccaatctaaacttctgatctgcagaactgtcaaataataaatttgtattgtcataagctgctaagtttgtggttggtacaacagcaacagaaaacaaatatattatccaacatactatcccagtccaaaggccaacagacacattagtttaaaatcatagagtaaagaattgggacaggaaccactactatgaaaaaagaaagttcttaacactataaatacattttccccgatattccttcttttagtcatatcctcagagaaagtaaaatacctcgagactaaaggaaaaagaacacagggagtgtatatctactcaagtgcaaattgtcctcaccaaggaacttcacaaatgtgctcttcctcacaggcaagaatactatactaacagtgcaacattactcaaaccaactaaatccactctcttcaacaggaaaaatctgaaaagagcttgaaagtttataaaggcatgaagataatgaacatttaagaaacaatgaaaaaaagagaaagaaagtccaggcaaatgtacccaaaattcacagatcacatgcctactggggtatgttttgcctactatacaagttgtcttataatcatacctttaaaggaaattatcttcaaaaactatgattatttatttttatatgtcatcaccaaagctagtttttaaaatttatcttccaaaatgaattttctttcttactcatattttttacacagctagcttctggtcttaactgaacaaaggaatattggaagaaaggcagttatttccaatgattttcggcattgaagatttagaaaagttaacctttgaaaatttactcaacttcagaacctaaaactttttgaggtataactaccaacaacatgctgaaaacaaatacttttgcaatcgactagaaataattttcacagtaaaaggtaaattctcagcacgctgcacatattctactttataattatatcacagtatgaaataatatgaaagaaaataaggggaacaaaccaatataatgatttaaaattcttatagaaacaggataaatgaagttaattttatttttctgttgagatagaaaatatactgagctaaaaattactaataccacactttgaatcttcccttttgtcttccatggaggccacacatggaaggatagctccaatgacctgggtaagggcaatgcaggatagaaatggccacgtgagaaaatgtacacacattcctttcttttgaataccacattctgcttcctagaggtccctgtaaacttattaaaaacttcagtcattttgtaaggagataccataatttcaaggggctttgaggctcatttatagcaaattaatccccattttatgtctgtccccatttaatatttctaaagggggtggataacaaatctcgccaactctctttttaagggctattcagatactaaataaaccaggaacatttaaaaatacaatctcacaaaaatctgctttgcttaaccttctctccttctttaaaaaataagaaaggcatgatgttctttttttgttaattaattcattttagacaattccttaaattttcattttaataaatttttgtgtgggtgcattaattactctcaaagatgctttacaactgttacctattaaaagcctttgttagtgaataaaaaaaaagaaaagaaaagaaaaaacttccagcatgctcccttccttctctattctgagcaggtccttgctatcaactgctggagtatgcttgctttgcacctagagctataattattttgctttaattttacaaaaccttttgttccattcccacgagcccacctgatccttatattacactcgctctattaaaacactcatgcagaacaaagcatggctgtactgattcataagtaactttttttttttcctcagtaaaatgccactggctaggcttcgggacacagtcctgggcttcaccatcctatgccaattttcatatgttagaacaaaaaaaatatgttgtatcagagtgttgtactcttccccaagatccttcctttgccccacttgttttttgtgtttttaaacatattttatcttatacttaactttactctggggcaatatacatgacagaatgttgaggatggtggatatattaaaagattgtaatcatgttgatatttcttttattcatgtggttaaaattcttaaaaatgacttctgttgccttatttaattttttttttctttctccttactccacctcttttccttgagatcttgcaatacatgtgggcttttggcaaaaaaaaaaaaaaattgcagtgactcatcaagaaaactgtttgtttgctctgaggagcaccctgaggaccctctgggctgcacacggagccctttgatcctaggaaatttatttcttccagatgttttcccgacagccacctttctgcaatgtccctcttcattatgtagcataagaatactcaagacccactgctatggtacagttttcctgaatggagtgtgacagggagttgacatttgattgagctgttggattcttcttgccttaggcacaatgatggaggaaggttaacactgaggaaaggcagaactgggtctgttcaggtacagtgtctttaggattaggatggaaattatgtgaaccaggccaaagaaattatgtaaaatctacaaatctgcagaccattgatcatggacctagttttcttcaaccctgtaaaatcttgatgcctggatctgccatgttgttactcctccaattttttttctttttttttttttttttactaacatacaaagtgcggacaggaaagttaagcctttggacaactcttgttttttcttggcctggctgacagtgctagcggaaaggagaagggagaacaagggaagaatgcagagcaggtacaaaggtaaacatggtgtggtgggctgaataatgacatctcaaaatgtgtccacgttctaactcttggagtctgaatattaatttaaatgaaaaaaaaaaaagactttgcaggtataattaaattaagaattttgacatatggagcttatcctggattatctagatgggccctaactacaattctatgtatccttgtaacaggaagattccacatggacagaagaggccaacttaatgtgaccagagaagctgagattgcagtgatgtggccacaagccaaaaaacggtagtggtcagcagaagctgaggaaggcaaagaaaaggattctcccctagagcatccagaaggaatgcagccctgctgacatcttgcttctcgcccaatgataccgattttggacttttggcttccagaactgtgagagaatagatttctgatggtttaagtcaccaggcttgtggtagtttgttatagcagccacaggaaactaatacaaatggtaaccatttcaaaactccattgttcagagcatttgtgaaatcactgaagtctcaggttgaaggcacagtggaaaacaggatgccaaggcttgaagacaaaattctctgtggagatactggagatattaagggcacttataatctacagcaagtagggaactaaaacagggcaaagagagtgcacaagggcattcaacagaagattaaacagattatgaatgtaaatgttctaattttctaatgctggtttgcattttttatgaagtaggacaaatctatagtattttccatttaagttaatgcttacacacataatgtattaccagccattttccccctaaatcaattatcagtatcattaactttagtgacatttgatttggcaaatataaactatatttggcacatatatactgtattataaaaataaagatcctctatctgcacttgaggtaactttcctttagctattcaaagaaaaatctatttttaaggtttaacccaaagataatatggaacctaaacccaagaattcttaaatagatatattaaaacaataacttggctgggcatggtggctcacacctgtaatcccagcactttgggaggccgagggaggtcaggacttcaagaccagcctgactaacatggagaaatgctgtctctactaaaaatacaaaattagccgggcatggtggtgcatgcctgtaatcccagctactcgggaggctgaggcaggagaatctcttgaacccaagaggcagaggttgcagtgagccaagatcacaccattgcatgcagccaaaaaacacatgaaaaaatgctcatcatcatgggccatcagagaaatgcaaatcaaaaccacagtgagataccatctcacaccagttagaatggcgatcattaaaaagtcaggaaacaacagatgctggagaggatgtggataaataggaacacttttacactgttggtgggactgtaaactagttcaaccattgtggaagtcggtgtggcgattccgcaggggtctagaactagaaataccatttgactcaaccatcccattactgggtatatacccaaaggattataaatcatgctgctataaagacacatgcacatgtatgtttattgcggcactattcacaatagcaaagacttggaaccaacccaaacgtccaacaatgatagattggattaagaaaatgtggcacatatacaccatggaatactatgcagccataaaaaatgatgagttcatgtcctttgtagggacatggatgaagctggaaaccatcattctcagcaaactatcgcaaagacaaaaaaccaaacactgcatgttctcactcataggtgggaattgaacaatgagaacacatggacacaggaaggggaacatcacacactggggactgttgtggggtggggggaagggggagggatagcattaggagatatacctaatgctaaatgacgagttaatgggtgcagcacaccaacatggcacatgtgtacatatgtaacaaacctgcacgttgtgcacatgtaccctaaaacttaaagtatgttaataataataataataataataataataataataatacacattcaaaaaaaaaagatcacaccgttgcactccagcctcggcaacaagagcaaaactccatctcaaaacaaaacagcaacaacaacaaaaaacccaataacttaaaattggaaaagtccaatagcaaaattattgtgaccaaaccacccagtttatccctttctctagttcatcgttaaaaacacttggtagcagcattattaataaagaactaaaaatacacctgaactctatgattcttcttagctatatggcttttcaacaaccaaaccattaatcttcgtaatcaccatgaagctaatagatgtagactacagatacagataaagaaataagattatggaaagcttaaagagattctagatcaatcagcaaatgagaagaactgagaaaatcaagtagaaatgctggctgcgttctctagtacctttgaaaagctactagagatagaatccttcttttggagaaaatagtccaatgacagaacatgtaaaagatggacagagtcatttattttttgctactttcatattaacacagagtattcatttggcagtagttttcaaaacaagaagaacagtctatttttaaataaaattaaaaaaagtaactgatgattaacataactactgtaccaaaagaaagataacataagtcattcaaagtaccaggaggctaaagaaattctaatagttatccctatacaccttcatttcaataaacatgaaaaatgggaatctcaatgtgttgtcttttcaatttcctaataataccagggggactcaaggcagttcaaatctcaggacttcagaggccactgagttccactatctggggtgctgagcagtcgatatgaattccaacttcatactctccttgtctccttgttctatttgctttaacactatgtacacctaacttatctttagaaggacaggatgcatatcctttctataaaaaaactatgcagattttcatagtgccatataattacaggtactctttatttgtttatgaacccttccaacaacccaataggcaattgttaacattcccatttatcactatctcacctatttctgagttcctagagggttgagaacattcttttcctgttactatcttctcttagttctatcacccctggtaagaagttaagtagtaactagttgacatagaactcacggcaccgaagaatgggtggccaggatcagtgcagattggttcatttgggtttgtaacctttgtgataaattattgagtgctatagagataaaatataaaataatttttaaaaatcctactacaaaactaccttaacccttttagcacagattatgatcctgaaagctaataatctgtactgtgctataacaaatataagaggatgcctttagtatgataaagtttgctgtgatggagaaatggttgagataaatgggactttaaaatcaagagtcaagaacatttggaaagatatgagatacacttaggaatcttacaaatgaacaaggacttgtctctagtttcttagtcataatgtttctaagacacaaattaatcaaaatcccaggttatcagttacttaatataaattttccaataaacaccccttgattacacacttaggtcttcaaagtgggtagatttatacaattcccctctacacaggcaaattacatacacaaaaattatgaagttatttttttctttgaagtagtttagtgaatttttaaaaatctgtaatgaataaaaccagactttaaatcctgaataaaaccagactttaaatcctgaataaaaatgttctgtatcaatgattgtcatgatatgtgtcttggtaatagattattgcataatttttttcttaataaaatggtatctccatcaaacatgtagatcatggagtcttcccatagggacttttaagatcatgtaatccaatccttcattttacagatgaagaaacaatatgtgagtgttttaataaagcctactttaagtttttcattaagacaaaaatggttgttatatgaagagaaaaggagaaaaagaattaatagtagaaagttggaagtgaagagtgaggaaaaacagaaaggctttttcattggtgcagagcactaagcagagatgcattctctaatatatatccatgtcattgctagagactagcttaaatagtacaaagttggtaacatccttctcttttcttttttttgagacggagtctcgttctgttgccaggctggagtgcagtggtgcgatctcggctcactgcaacctccacctcccgggttcaagcgattctcctgcctcagcctcctgagtagctggaacaacagacatgcaccaccatgcccagctaatttttgtatttttagtatagatggggtttcaccatgttggccaggatggtctcgatctcttgatctcatgatcagcccaccttggcctcccaaagtgctgggattacaagcgtgagccaccacgcctggcccgtagtatccatttttaaaataatcacttagattataaacacgtaaacaatttagacaggtttacctctagggaatcatatgacttaccataaataagcaaacatattctgtattaccaacatgctaactgttcattcatttacactgtatattacctctcacttccccagaatatgcaagttgaaggaaacataacaaccattgtaaaactctatcttaaaataaatattattctataaagaaaaaacaaacatttttaagagtcatataaaggcaaattttaatttgaagacttgatactaaggaataaatatatatacctaatatgtattcacaaaagttaaaaactaatttttttaatgtaggctgtggaatcagactccctgggactgaattttgattttgccccatccttgaccttgggcaaattttttctctctgtgcctcagtttcctcaccagtaaaattaggataacaacagtgactatttacaagagttgttgtgaggatggaatgccataaatttacatataaatcttttagaacagggactggcacatagtaattaataaatgttagctgttacttctaatatgtacaagcctgttaaacattttgcaggggggagataaggtgtttctcattaatgggacttgttaaggcattttgtctttcaaatggctgcctaacttaattcataccaatattttatttcagtaggattaatgaaatagtatgaggaaaagccttagtgtggtttctttagacatgtttgagacagatattctcatccttttaaggggagtaatctaaaatgctacacccatttgtggcttaaagtaactgagaagtgactctcacaagatgacatgatttagctgtgtccccatccagatctcatcttgaattgtagctcccataattcccacatattgtgggaggaacccagtgggagataactgaatcatgggggcggtttcccccatactgttctcgtggtagtgaataagtctcatgagatctggtgattttataaggggtttcccctttcgcttggctctttccttctctcttccctgctgccatgtaagatgtgactttcaccttccgccatgattgtgaggtctacccagccacgtgaaactgtgagtccattaaacctttttttctttataaattacccagtcttgcatgtctttattgtgagaacagactaatacacaaggcaaaggagaaaatgggggagcagaagaggcttagcaggatgcatacatcttctgatatggagaacatgaaagcactcactgaggaaagtggaggtgctggctcttcagcaagcaaatgctccacctatatgctcccacagtatcttatacatgtctcaaagcctttaacctgctgctttgtaatgatttgtttacatatacttttttttgttattatatggtcttctacttgaagacaaaaactgtcccattcacttttgctcagtagttgctcagtggcatatttctggattgaatgacttagttaattaataacagttactacaatgggggaggctattgattttaaagcgagagctaagactcacaggttctatccaatggaggggcgtgttgaagtagaagtagctagctattatggtactgacaatggatctctgatctctgtgctggggataaatgctctaagtgagcatgaaatatttttgaagtttatacatgtgtaagttttttttccccttaaccataataactttcttttttaaaaatgcatgaatatttgagtaactaagtgcaatgttaatgttgggtgcaaatataatctgcctaataaaccatggaaaaagcctgaaaataaattcaataaatagagtcctagataatgtgttgtgggagatgagagaataagcaattaattatagatggtggaattaaggtaattttagtagagaaggtaatatttgagcaggatcttgatgcaaatactaaatctaaatctgtgaaaatagagcttatatccttaatgtagaaactggctgatatgcagagataagttgaaagtcctgtgaataggtgacataaacatcaaaggtattcctaattcccaatatacttgaaaaattggctattatttgatgcatatatccctgtatggcaatcagtccagtaaataaaataataataatgtcctttaaaaaattcatttattcatgaatattcattcatccattcactctttcaacctaatgtgataatctactgaatatcaaattccgaactgtgctgagtacattggaaaccacggtggtcaagacagaataaagtctctgcataagaagtaggttcagacaattaaattaataattataatgcaatacatattatgttaggtaaagtactacatgttatggaaatatgtaattataagcaatttatacttaaactcattacataaatatggcagaactatatttggataaagtgctggtggtttttattgaccttgaatttcttctgatttggtcttgtttacctacagagtagactgccacatctgggtcttacttatactgtttgctattcaaaatcttgcctcttgaactacctatttaattatggattcatgaagcacaaatcaatttattttcttaaattccttaagactaaacatggcagcatttttcctactccagtgtttctcttctgttaagatacatcttttggccaggcacggtggctcatgcctgtaatcccagcactttgggaggctgaggcgggtggatcacgaggtcacgagatcgagaccagcttgaccaacatggtgaaaccccgtatctactaaaaatagaaaaattagctgggctggtgacacgtgcctgtaatcccagctactcaggaggctgaggcagaagaattgcttgaatctgggaagcagaggttgcagtgagctgagatcgcgccactgcactccagcctggtgacggagcaagactctgcctcaaaaaaaaaaaaaaaaatacatcctcaggaagatgatggtgatgatgtatgaaactgaaaaaaatatgcttagttttgtgagattagatctacagggctgagaagagtaaaatcttgtttggactagtatattgaacaaaaaccacataggagtcacagtggaaacaattataggcaataccaattcttatcattttaatgaggagaagttaaagttggtcttttcgttgtggttcttaaatgcaaggtataacctatagtccataacaaatttttctttagaaattatcaagtacacagtgggttttctttagaaaccacaattctagattttttaaagcagaaaatatgctgtcctccttcattttaattcttttggaggaatagaactttttttttctttctatagttaactagagttgccacaggcaagaggactaacagagtaaaatactaactgatccaatatatactgcatttatctaactggatttcatctagctcaacatcatggctttgtagtctaagcagtagatgaacagaaacaataaactgggcaagtaatgttttgtgtgaataacagaaaagagtgaacagaaatataacacttcaccattgcacaaaatacaattaaatatgatttttaaaaacccagccactgatccactgcccaatcataaaagaattgtaatcagttcaagtagtcttaaatatagtgaaaatgtcctcaagatacacagcatgagagaacaaagagttttcactatcatctgctggactcagggaaggtgtgctatgtggttatcatttgagtgctctgtgtttaagttaatcaatattataaattatgcatgtattttagaagttcataatttctattaacttgtaaagttattgaaaagaaggatgaataaaccatactacaaaaataagaatgtgaataaatgccagtttttcctcagattacagatgatataacatcgctgctattttaagaaaatgagactggatcagatgtgaacatttatcccttctctttaggatagcctatgaattcaacacattgacactaattataacaatagctaacagttaactggagtactaaccatgtgcaaagcacactgtaattatttcacatatattatctcatttaatgctaacaacaatactatattataaacaaggaaactgaggcaaagggaagtcatttgctctagatcaccagggtagtaacgggtggatgtaggattcaaaccagacatactccagaatccatacaatatcagaatagtctgaccccaaaagacacacacacacaaaatggatctaaccaataccttgggaacatcatctaacttttctgggctttagatccttcagctgaaataggagttgacaaaccttttccaaaaaggataaaatcttaaatattttaggctttgtgggtcaagaggcaaaatcagagatgtcatgctatttaggtaattatataattggagagaaaacttgctgtatctcagccagttagatgaaaaacacataatacaacaggaaaggataatcttcaaactattaaattatattctctttgtacgtctaatgtggagacaaattatattaagaacacggtagctgaaataaaattatttcagattagcacatcaggtgttgaatgttatcagtggttatcttagggggtgacagaagaagattttagggacagagggaagttttttcacttccagttaaaatttattttttaagtggtggaattgattgttatttattattattatattttactttgtgttttggagtagttttcagtattttttcctggttttattgaggtaaaactgacaataattttacacatttaatatgtacaatgtgatggttatcaaatacacattaccacggtcaagattattaacatatccatcacctcatatagttaccattgtgcatgtgtgtgagtatgtgtgtgtgctgagaatacttcagatcttactctctgcgtaaatttaatggatgcaagtcagtattattaactatagtcactatgctgtatatttgatcaccataagttattcatcttataattgaaagtgtgtaccctttgacgaacttctcctgatatccctgtccccagctcctggcaatcaccattttattctttacacttttgaaatctactttttttttcttaatttaattttaagttctgggatacatgtacaggacgtgcaggtttgttacataggcaaacgtgtgccatggtagtgaacagccatgttttcaatacatcacaagccatagtagtgagaaacaccatttctttttttttcttttttaattattattatactttaagttctgggatacatgtgcagaactttcaggtttgttacataggtatacacgtgccatggtggtttgctgcacccatcaacctgtcatctacatcaggtatttctcctaatgctatcccttccccagacccccactccccaacaggccccagtgtgtgatgttccccttcctgtgtccatgtgttctcattgttcagcttccacttatgagtgagaacatgcggtgtttggtcttctgttcttgtgttagtttgctgagaatgatggttttcagcttctttttaaaaagattccacataaaagtgaaatcacacaaaaaaaggaatttcagaaaaactaaaaaattgaattaatatactgtcataggaaaaaacagaatttccaagaggagtgggggaaaataatagtatcagaaatataataataatagatctttttcctgtggaaaatagtacatagaaatagaaagtactgaaaaggagaatcagaaaagattatggctccagaatcacattatcttctacagtttgaagaaaaaaaaatgtggctaaaagaaaaaaagtatttccattacacaccttttataatgactagaataaaaaaatactaatatcaagtattgacaaggatattgacaaggatatggagctactgaaactcttatacattgccagtgggaatgcaaaactggaaattacccaaatgtctttcagtgaattaatggtaaatgatcttctgtatatccatacaaaggaacactacttagcaataaaaaagaaacaaatcgtgaaacatgcaatgatatgaaagaatattttattttatttttttaaagacagggtctcactctattgcccagactaaagtgcatgatcatggttcactgcagtctcaacctccctggctgaagtgatcctcctgcctcagcctcccaagtagctggaaccacaggtgcacatcaccatgcctagtcaattaaaaattttttttccttagagacagggtctccctgtgttgtccaggctggtttcgaattcctgggctcaagcattcctcctcccttggcctcccaaactgctggaactccaggcatgagctaaccatacccagccatgaatgagtcttaatgcatcaagctgagtgaaagaagccagtcttaaaaggttatatatatatatatatatatatatatatatatatatacacacacacacacacacacacacatatatatacatatatatacgtgtgtacacatatatacacgtatatacacatatatatacacatatatacatatatatccatttatatgacacgtatacatatatatccatttatatgacaactcttggaaagacaaaactataatgataaaaagatctgtggttgccatgagttagtggtgagaggatggataaaggaagaagttcttcagtgtgatggaactctttcatattctgatagtggtggtggtgcttgttacataaatctatatatatgttaaaattcatagaactgtataccaagaagtttattaatgtcagtaaaaatattcaacattttcagaggaaaaaagggagtaactgattacatattgaattattggaaaatacaggctcaaataaagccatggtttctcctactaataagataatttggtaagagataacactgttgatgaaaaagaaacctgcagttctacctccctgccattagttgaccaaaatgagaatgtctaacatagctacaaatttaaataattctctgcttgtttaaaacatagtctctaatagttcattacagtcattactgcctgttaatcaaggataacactagtatttgaattttgtaagtatgacagcaaggtaaagactgttacttaagccaataaattaccatatttcataaaaatctaatgattctgtgaacagactatgtagttcaatttttcttctaaaccctgtaactgcaatgtattttcactgatatttttaaagagttttcaaaggtacatttttttattgtggtaaaatatatattaaaaattgaccattttaaccatttttaagtgtacagttcagtggcattatgtatactcacactgttatgcaagtatcaaaaccacctccatctctagaacattttaacttttccatattcaaactgtgtaaccattacataataatcccatttccccttcctcctagcccctggtaacctctattctactttctgtctctaggaatttgactatactaggtacttactcggcacaatgcattaaagttttatccatgctatagcatatgtcagaattttatttctttttaaggaggaataatattccattctatgtatggaccacattttgttaatccatttgtccattcatggacatttggattgttttcaccttttggctatcaactgtgcattccttttgacattattgtcagccaccagttttttcctcactagtcagactcaagtcatattctgacactctttaggaatataggacatttcatttacaatagttaggtttaaacaggatgtattcatttgctctcacactactaataaagatgtacccaagactgggtaattatttaaaaaagaggtttaatggactcacagttccacatggctggtgaggcctcacaatcatggcagaaagtgaaggaggagcaaagacatgtcttatatggaggcaggcgagagagtgtgtgtgtaggggaactactctttataaaaccatcagatctcatgagacttattcactatcatgagaacagcacaggaaaaaccgcccctgtgattcaagtacctcccactgggtgcctcacacaacacacgaagattatgggagctacacttcaagatgagatttgggtagggacagagccaaaccatatcaggggacctttcaagtttggtcacaaggtctaattaattattttcatgcataggatctaaagagcaattgtatatttatcaacttatgtgttcaaatttggtcattagcttaacatatgtgtttgtatgcatgtcacatgcatatctgtgtgatgatacatagagctgtattatgcataatgttaaagctttattattgtctggttagagaagcagtcactatccagaaaaatggtttccaatgtgaagaagcatgttaaatttgacttcactgaattgaaaattttaagatgaaacaggagttgggttcctataagcggttagcgtgcaactagactccatcttttaacaaccaaagcagaacatctgggtgggtccaatgcattaacattttaaaaaaactttataggttttaatatgcagctagaattaggaacctctgagacaaaatgatcctgagttgggggagctaagagtaaacaagtgaaggtaattttaaaagccggttagggcctggagcatactgagatgaagggaagagaaatttagaattataaatagcaaaagatccactcaagctagaaaagattaagtatccttttagagttaagagtagaagaggcatcagttacaaggataattaatatctagattataaggatctgctattataaaacttatactagaacaaaagtcatgaaaatggtctgcggaagtcatgaggtgagaagaagataaacaggtaaatatttaagcagattatagagttctggaaatgtcatcaagtctcttgattgtgtatatttttgttccatttaaacacttgtcctgaggtttataagtgaaacatgatgtaatttatcatctaagtaaacatttatcttatacaccaaagcacggtgaatacacacacacaaacacacacacactcatacacacagacattttcattaacaagaactagtaccaactacagctcaggaaatatttgttgattaaatgaatcagtctgcttacagtatgcattttcttttgtgctgcagaagttgcaatacaaatgaaactaaaacttctgtgtgctgattacttttctcagtctgcttatctgagaattaaagaatttttaaaacaattttatgtattaatttgcaaacttctttaataatagatgttcattgtaactggtgaaacaataaaagctatttaaagaaaaaattaataatctttcctgattcctttttttgttcccaactctgtgaaataaccaatgtgaagaatatggtatgaattattttctatagctttcttcatgttcatataaacatacgcaacatatttattcataaatactcattaccctgaaaattatggtcattcttccaggttaacagctatagatataattcattcttttcctaatggctgcattatcttcaataacatggatgaatcatctgtccatatcatatgatatgcatgtagtccaattcaagaaatcagtatactttttttttttttttttacaaattttactaaaagtattactaaatttttacacaggatgctcaacaaacactgaagacctatctggtaccagctttggtgaccaagaaagaaaatcagtgaggtactcctggttttttgccctccagaaagtcactgactatcataggggagacataacagtaagttttttttttttttaatttgagagaaacttctcagagaatttatagtaacaaatgcttttaaagcaactatttaaaagaagtaatatatcactagcaattcattcttcattgtttccaatgcatgatcagtatttagtagcaacagaagacttccctatatgatgactcaaaaacaaatttccaaccactaagaactcagataaaggaccttactcttgagacctcaaagtgatttacatttccactagtacttctattgtaatatatgatatttataaactagccttattccatggaactctaaatatttaatgcttcacatatatcatttgacttttctgcatgtgtcattaagataggagaaagtgtcccctacagataaggaaaatgatgttaagacaaaactgacaacacctgaatcaagtctccagatagccccatactctttccttccaattatacttgctgccttgctagtggtaagcaatgataacgtagacagtattatgtcatcaattagagagtctcacttagcttgatataatcagtttttatttaaaaatgagagctttccatgcaaactgtttttctatcttctaaaaggcttgtgactaaaacttcactgacaagtttttcaggtgagatgagtgtaggttaactactgagcagccagagtctagtcaggcccctcacactttccagtgctacaagaagatgagcagatgtggggttagatgtggaacccaggttcatagctgtacctgccaaccctaacctagagaagggaagagaacactgatggtaaccatggcaacagtaacaatgctacacatctatcacttattgattatctaacaaagtcttaaaatatcaagtaatgtaagcaaagaacaattcagtgaaattttagcaaaggttaggcaaattttatatggtcaagatagtacatttgcaaacaagtagaagaccttgtcaaaaatctaaatcttctaatatccagtaactctcttgtctgagccaatttattttcctacatctttgaagacattttattaaaaaaggttataactgagaattcgacagtaatcagaagagtgatcttcattctgtattcagtgtctcttgaccccctgaaagaatctcagctcagcatggcttcctcccttttccagttgactcagagaacggtgctttcaaattgccttttgggatacatgaaggggtgcatttagagccaacctgaagtgtaacactctttattgttcctgagaaacgtgtgcccaattccctagaaatttactgtttcaaagagtcacaagctcctgattgcttctcatcagtcttgaagagattagataagcttcctccctcttacaaaagctttttcttcattcaaaattcctttgagaacaaaacattgaaccagaattggatttttaacaaaatattataagattgttgaaaacatttttttttctcctgaggagaccaaacaattcaaaagatatattaatgcacattctgatttagggctactagcaacatattgcaaagagtaaggtggtgccaaagaacaaagtcccttctgctaagcaggaaagatattttttaactgccttactttagaagatttcaatggactgctaagggctttcacacagataatctcagaagtcaaagctcaagaagtagggggaagaaacaactactggaggaccctaacaggtagcattgcttctaattaccgtaaaattgttatgtatactgatgccccacatcccattcccagactcagataattattctacagtaagagttggctttagaatacttgttcaagtgtgtcagtaatagaaaatgacctcttcagaaatgggggtgtttacatgcagtgctcctaaagttggcacacatggaaggtaattcagggttatgtttgcagtggcacccatcatcagcaatgtttcaacccccgtccatctctctgtcctggttttaccaagggattcacttcaaatgtattcctcactggtctttagaaaacagtgctagcaattcataagtatgtttgaattttcaaagtttttctttttctttttctttttttttttttttttgagatggagtcttgctttgttgcccaggctggagtgcaatggtgcgatctcagctcactgcaacctccgcctcctgggtttaagtgattctcctgcctcagcctcccaagtagctgggatttcaggaacctgccaccatccccagctaattttttttatattttttagtagagacagagtttcaccatgttggtcaggctggtctcgaattcctaacttcaagtgatccatacgcctcagcctcccaaagtgacgggattacaggcatgagccaccgtgcctggccccaaagttttgcattttgatagcagcaataaggctgagtaccttcataggcctttacctctgatcacactataaggctttaattaagttagtcttaagaagaaaaatgtacaccaaaccccaattattaaacattggaattattccttcttattggtctaataattacaattttttacttctcattcatttttcaaaggtttttttcagtagatctaggttattggaacgattatatgtgatatgatggggtattgggcacagacacagtaaatcaagatgatgcagaaatgaaagtctaatgctaaagatcttaccaatcttcccagatccccatttttcaaaggaggaaatgtatagaggacattacatttatttccagccattatgatataattataaagccaacctctcaacgcactctctctttttgggaagtctatgacagcaggtattacaattctactttgccagatgaggtgcgtaaaccatagaaaactaactagcatccaagagaagaacagacttggatgtgggtagaataataggaagaacacttacagtcagatatatcagagtatgaatgcaggctcaagcttttttccactaaaatgtatacagcaatgtaatctcactgagcctcagtttctgatactgtgaactaaagattatgacatcaatctacagtcaatgctgtgagaattaaatgtgaagagttttatggagagggcatctgctaaatgtaactatttttcttaccctcctaaattttttcagtcttttagacatttgggctattagagaactaatgacctctgtgaccacactagcttaggctataactaaatgcaacagatttaaaaacaccaagcaggagatagcacagagtttgaatcagtgaggtctaatagtaatacaaacctcacttactggctttgcaattttagatgctacttaatcgttctggggctcagttttttcattataaaatgggaatggttcctactttgctgggtagttgctgagtgtggtagcaaggattacagacaactctttatacagtatctggtatattaggtaaatggattgtaatatatattgttcagattttttattaattaaggtttgtacatagactcatctcctgcacttaatatttctttttctacacaagaccttgaaagggttatgataggggctttgatcacatattagctggtttggctgtggtaatttagctcctgagtattgggattacagtaccagcccctgccattgactatttaactatgacttggataggaattctaggcctgaattttgttcgtctccaaaatgaagaggttagaataaataattcctaagattccctgtcgctataacattttctggttccagggtctttttactgagctatagcagataaatcctcatatctttagagcttaagctacttctctatggtttaatttccacattccctctactctatttcttctttaattgcaaaaggggataatttccatcactttgcaaacaaaccaatatctctattctggcttagtggcataccatgttattaatgcatcatacttaaaaaaagcctggattgttcttcaatccagaaatccagtcatgttgtaggtagtaataatgagaataatgatgatttattttcaaggttttctatgcctccaggtgcccggtcattgcacatgataaaatacaccaaaattaaaaatgagattaaggtttaacagataaaaaatacattctaggaacaaaacacatttttggtatgcatctctacattacacaacagccacttaaaaataaacaaaaacaagaaatccgttaaccaacaacagaattttaataattattaactagaaagaaaataaaattaacttgaccttatcttagaaggttgtcagagatctactctgtttatgcaagtgagaaatatgttttgaattataagacctctatttcagaagtccaagctctcctcaaactcagaggtaaaccttcaggaaggatttaaaataaatgtatggattttgttagcatgtgtatattatttacctttgaattaattttgatcttgtcctattcttgagctatccttcaattggtatttttgtgtgtatctactatgtgctttcccactgcattcagaataaaattaaaattcctcactctggcatttctctgaccacacctccagccattctgctttgctcactttgctctggccactctgaagtccttttagttctttgaatacagaaagtctgattcaaagctttgcatttgaatacaggattttgtatatgcagtttctgtctggagctttctcccctcccatactccgttctctaccccaaattcttcacctggctgatattattttctgtccttcaatgttcaaatcaaaggacactctctctgagaattctgtcctgaacacccaaaggacagtataagagatttcccccactcaatgttgtcttgcatacataacactttatgtggaccacagcttgtaatgttgtaattatgtttgcacttattacatgtctaatttccttaggagactatcaatttcatgatgaaggtctaagggatcatttctatatttctactattaaatatagttgaataatgaatcaatgattctattgtggtagactcagtagggctaagaaatgttaattaaatatggactattcccttaaaattttgttttctagtaaaggaataaggcatacacataaagtgctataaaatatagaaagtaattcctgtctcaataaaagtgtagatgagtattgcattagtttcttagagctgttgtgacaagctaccacaagcttgttggcttataaataatacccaatatttattatctcacagttttggaggctacaagtccaaaatcaagttgtcagcagggtcactacaggtggtaagtaaatttgatagttaggggagagtggattgtttctgtccaggtcaaggaaagaaggattcatgaaattcataacattggaaatgaacttggtaggatgggttggatttgcatatgaaaaaattgaatgatggacattccagatgctggaacaatatgaataaaggtgagtaagagaactcggcctgagtttatagtacatacaacccggtaggtgacaattaactaagaaatgggatcagagttagattttaggatgtcatgtatattgattagggattgttatacacagaattattgaaagttttatctgaacaaaggcgacataatcttagtactcctatattaggaaagttaatggggcagcagtgtttaggataaactgatctccctgctccatctctttcaattaggagatttttgtaagcaagagaagataaaatcctgactggaacaggtatcaaagaaagagaataaatgagacttggccacttactggacatctaggatgtattaagaggaggaaagaatgatatattttgagtaaagatgtcctagagaattggagttagagaagctaggatagtcaaaagcaggatggtttttaagtagaagaataaattaagttttgatatgctgactcagagaaactagtgtgatttctagttgaagatttaaataaggatgttggaaatataggactaaagttctgaagacatatcaggactggagatataaatttctgagttatccatagtgaaataattgaagtcatgtaactctgagaagctgtgtcaagtcatgagaagagtatgaatgtggagtatgacagatgtgatcacatcctgtgtctactatttacctgttgtatatcctggggcaaattgcttaactccaccattttctcatatataaggaagaaaataattttatcccttaattaggattacatgagttaaatatttaaaagctctgtcatgtttaagctgcttttatattttggtgcataattctcataagaaatacacttattttgccatctagtatcttaaaaatatgtgatgtgctttaaaaaatatttattttcctgtgattctagtatatgtgatcttttaaactttcatgacctactaatgcgttgcaacccacactttggaaaactgatcctcccatacattatggttctcatccaattcctcctctagtcactgtccccaacaagcattctatgttgaaatcacaccaatactatcaatgttctcctgactttcatttattactccctcttcataggcttcttgctagtatcacattattccttcatggcctagaaaaaaatgataaccatttacttcctctgctattccatataatgttttgtctataagaaagatgcgattttcccagataaattatgaattccttaataacagaaaatatgtgttatttatctgtgtatcttggtaaaatattttgttataggaggcacagaacattaattcattattataaaggaaagggagaagaggtttgaagagagaactttgttgaacatctacatctaggaccctgctctggtatcaccatgtctcgattcctccttctctatatgccaaagcttccatggaatttttaaagggcagaactattgtctctttgtctttgaggcacaaagacttaaggccactaactttcagtacatggtggagagagggaagacctggatgggttaaaataaaggaagaaactagaaaatgtccagaatttagctttgggtaaaataacaggtttttaccgtagcctctttggattggtaaatgacagaatccaatgaaagcaatgtgaaacaaatgaccagagcaagtaattcattttaaaatattaaagcttatttctttttttttctgactctggaaaacttttctctgatggaaatgacccctggcaacagtgacattctgacaccatgcgtcgtacacacccttgggaagtttgaattccacaccactatggttctgttcagattactggtttcatcatgtctgtaagcccaattaaactactgaagttctaatggtcttatgtccactttgtaaatcatcataaagaatattaagtcaaccaaataaatttgcctctacaggactcgttgctcaaccaaaggcatgatactaggaacaaaattaaaaaacaaaaaaacaaaaaaaaacacacaaaaaaacctcttttgataacaaccaatgttttcaggatactcctttatatatgaatttgagattctgatgaaggggactacaattcaacaagtctcaaaaaatgagcccaaggcaatttgctcctcaggaaacattgcttagaccctgattgtagtggaaagattgaagcctcagattgtaaattcagatagactatcacgtctaggtctctaaggatgatctgcgatggtggtcaatatggtttgtgtaacctttgtgccctaccctgtgcctcaatttgcttatttaaaaatgaagtcactagactttgtttcttacatcctttcccactataatgtttggtgatgctctgcccttacatttgcctaaacttttcaatcttaaaatatataaaatgtttttataaaattcttttatgtccttaaatgttattgaacatgataacagtagaattcactaagcctaaatttcatcattttaatattgcctcagaggtcaagttttatgagagccttaatttgcatcaccagaagctcatttaataaaaatgaaagaatcccttttggaaataaattttaaaaactgatggtggggaagaggggcagataaatgtatgtaaaaaagaaaaaaaaacaacttagaaggtgtcaaatggttctgagttctaaagaatattgtggtcatattagtgttgaaaagttggtcctagctttttatgcactaaaagtacattctgctaatggttccttcccaaatccctggcctcttgacccaatacttattgtaccacttgtcccatttccctgaaacaaaatctataatatggcaagacgaactgaggtatcagagcatcatctaccctggaattgggcatatttatttgtggagttgattctagtgtgtgggatataaaacacacaacttaagtggaaaaatgctgaagaccatttcataggtgaaaaggatgtggtatgaatggtcaattctcactttggtcaggaaaaagaagtgtaaagtcaatgaggtaaggggctgggagatggatacctcgtatgatatgataagcagaaaggttgtgtttggcaaattcctttatcatcttcttcctgactgtcaaaaactgtattcaacctgtgtttacaataaatattctctgacagaatgaaccctggatttctgacttttaaaaagttttgaaattaaactaatagcagctatttcatgattacctattattgtgccaagggttagaaattacaaaaatgagtaagaaagagagagcccctgctcttagagaccttactgtctgtgggtttgaactgttgtagttatgacaacaataacaataactatcatttattcactcataccagccaggcaccatgctcagtgggcaacatacacaaagtgccaaagtctccttcatttcaccagatgcaatcacagtaaggtaaccttgctctgtccgtgcatcatcgcttaacaaaaatgaacttagcaggaattcagaccataggcagagacatataagcaactccagaactgtctactgtcaacacacaagaactacagtcaataaagagtgcaatgaactacagtgaaaatggaagcaattgtctgaatcacctttagtgtactctgttgactgggggctgtgacactctaaaaaccacgatacagtagactccacatctggcattccaacaatagaagggtaagtgttttaagactcttagcgaaagaacttgcaatacattaaactgtaaaactgaggaagacatcataagcttctggattttattaccaaaatgtacattttgatctaaaattaaaaataaaaacagattgactttccttgtagtatttcacaacctttgagtgcagcattaaaaatgcttttcttttttttcttcaccaactataagcttctgttttcttaccctgggcgtctgaatcttttatatgcttgggttctattcactgcctgttattcagacgttgaaatcccaaatgttaattgttcttccaagtacattgacaaaacagcagctaaataagggtagaccagactgtggtagactctgacatgcatttatggaacaatggggctctgagagacagccttgtagctcacgggaagacataagatgtgctattttgactgcttcgtagcagaatggggaacacacgcacacaagggaattatgcattttacttagttttgcccaaagtcctcaaggcaacagaatcttgtgatgtcatcatgaactttctttctctccatttccattgacacaaaggctaaaaatttctaatgacatcacaaaggaaaatgaaatctactttgattccaaaagaaatcttttaccttcagtgagactagtaaaaataaaataaaataaaataaaataaaataaaataaaataaaataaaaaagcaagaatctttccagacagggtgtgtgtcactgtgctcatgcacagtgggtgacaccctccctaatgaaattcaaaccagccaaaagaaaggattcacaatttaggttggataaaaaagacatactgaatattgagaccaacaactttttttttttaagaagaaaatcatttaaacatatatttcttcagggacattcaaatttttactcatgtctggttactatgttaccaatgtttttgtccttttttgggttggtcacagaaacacagaagaaggtacagaaagctttgacttacaggaatacagtgcagctcaatcttttgtttttaaggtgcagtgatttcagtctctaaatgtaacttcaggcagtctgaaaagaaacaggttaaaatctctttcagttataattggtatttcagatttaattaaaaattaaactttcataatgtttcaccatccaaagcaatgcattatcagtcaagcgtggcttttctttttttcttttttttttttttttctgttaaggaaaaaaaaaaaaaagaaaaaaccctcttcccagagtagttttttaatgaaaagaaaaggatctaaagaggagaaaaaaagcaattctgaaaaacaaaatacgcctccatgttaaggacttcataatgatatgactagaaactcaatgtttctgaattttagctatattctgattaaaaaaaaactcctaaacaatttctacagcctaaagattacagaaaatattaagttcagggaataaagaagaaaatctatgggtctgaatacacatattaaagggaaattatgacttcaaatggaattgtaagaaatgctagatctcctactttccagtgactgaattgctggtgaggtagatggtgaagaagggctaaataaacatatttaacaacacaaaatggccattgaaatgtactgtattatgggtttagcgtgccccatttcacatcatattgtacatcttgtcacatgcagccactgctgtttgaagcagcacaggaagaccaagagagtctgaacaacactccctggtttaagtaactgtaagcatgttgcttattttttaaatatgtacttataattccaaattaagtaacagtccaggcattaagagctccaagtatataataaatattaggcttaaaatattatactattttttgaatcatttctttcttcaaacaacaccatctataaataatagtattttttaaattaaaaaaatcacatcacacactagaattaaatcatccttacttttagctttgaaaaactgatacaatgggatttagaaaaatttagtttttaaaatataaaatgaggtaatataattcgctttcattcactttacagcgtggcagaatactttctatatatttataacactaaatgtcatatgtttacatccaatttcacattagtgcaaggtaatattttaatatttccccatatgagagcataatcacaaatcaccccttaaattgtactattattagaaagcatatgtagttcttacttgggattcctgttttctttttctcttgaaatgtatagaggaatattttgggtaattggtctatttgatgtacatagattttaagcgtaaacatgctcaggttcacagtaaattcactcatgaatgagattagatttaaaaaaaatcactgacattgactaactaaacttttccccctcctctcacatgcctgaattaggctaaaaatgaaccagcgtaaaggcagaaattatggaggcgtcaccagggacaactgaatgagaggaggggagtgcacattatttccttataaggcagcaaaatattcataaaagaaactgacaaaaataacttgtgctcagaaattatgagatataatataaatatattgaataacaataatctctgaaaaatgattcagaaatttaaaactgcccacctctggataaatctaattcaccaactggcattgttctactcaccaacaaaatatggttagcgaaacaaattcattctctagtttagacgtgaaaaggtgatagaaactaggctgaatatttacatataaacatataactaacaactagtaattcaattcattcagtcaggtttccttctcctcaatttgccagatgttgaatgaattgaactatcagctcaaaataattaaatcaattatatgaatagatggtcagtgtaccaattttcattccccccccatgccatttctccttctcctctttgatctttttcttctatttctgcttgtttcttctccactttcactttctttcttattcctttttccttcttttttttttttctcttggtgagggtaatgaggctcaaaaataacatcttgtatcctgttgagggaaacttggtcacaactatccttccagatgacaaactcattcttaaatgtctgtttcccaatccaaagaaaacagagcaattgaaaaaatagagactcaacatcacttacaactaccaacaccagccctcttaattcccatgctgtactactcatcacgaggagaactgaaatttatttacattatacctaacctcaaataggaccacaaataagactaataacaggaccattttgtggcactcaggcaaacggctgggcaaaacagatggatcttactttgcgccaggactcaaaaaatatagtcgccaactcactgttggcgactacatatcttggcccaaagatggacctggaagtaggaccagttgtctttgatatgaatagtgctcctcttcttatctcctcatggaacaaatcagtaactctgtcactatatagtggggttatcaggtagaattgcttaaaagactggtcatcaaggatgtaaaatattctgagggaatgtcaggtgagatgaaggaacagaaagtcaggacaaataccttatttttggcacttttgtctattttcaactttctgtttttttttttttttttaattcaaattcactactgtacactgaacccacctttaaaatagatttcagagtatgtgtcatcaataagaaaacttgtttctcacatttcaggttccaaaatctgttaaaattttaagtcacatagatcaatctcagtcattattaaaattgaccaccagtgtcagacttctttaattggaagaaaactatgtaaggctttatagattacagtcaacatccaatgatgcactgagcaacagctccgtaatcaatgcaatatacaaaatccggaagaatgcttctctggcagagaccctttagcaaaagagttgtacattctgcactccttaaagattctgaatggctttccagagaagtagcaaatgcattatattgcagtaacctatcttgtaagtcacaaggccacaaacaaagcctctagtcaataaaaaaacaaaacaaaacaaaacctgaaggggggtgagaactacagatcttaccattgactacgaacaaagggctgcttctgaccacattctactttctaaaatcctcacacagaaggagttttagatatcaccaggtcacagaacttcaaggaaagaacaacaaagcattccagcttaggaggtctatgttaattcaggcacttctcttattgctcttccaactattcagtactgactgtatcttgctcagattgcttttgagagttcactcatctctctataatttatttattcagacattgtgcagatttgatttttaagagacagccctgtttgtggtcagcatagaaggctaattataatactttaattatttattttagtatttttttctttccactatttaaaaactttttattataaaatatttcaaatatatgagagagggcagaatacagaaaaatgaactctccagtacccatcacccatagtcaattgtttttccaattatactttcacctactttttcttccaccagagcatctgaaagacaatcccagatagcttattattttatgcatgaatactttactatgtgttactgaaagatgacaatcataactaatatcattccacatcaaaaataatagtaattctttaatgtcattaaatatcctgtccatgttaaatgattgacttttaaatggtcttttctttttataactggttagtttgaatcaggatctaaataagatgtacacattatattcaaacgataattatcctttaatctataaattctccatttgctttttaaaattttaactttgtattttggaacaattttagaattatggaaaagttgcaatgatagtacagagagtacccatatttccttcactagtttttcctaatgttactatcttacataaccatggtaaatttgacaaaattaagaaattaatattgacacaatactattaactaaactacagactttattcagatgtcaccaatttttccattaatatgttttttctgttccaaaaatccaatccaggataccatactgcattttaattgccatgtctcctcagtctcttctgatctgtgataacttcttggtcattccatgtttttcatgactgataattgtgaagactagtggtcagatattttgtgaaaccttttacaactttgatttgtccaatcccgtaactagattcggattataggttttagagaagaatacaaaagaggtgatgtgcccttcttataacatcaaaggtatatgatatctcggggtatgttaaccttggtcgcttgcttaggagaatgtctgccaggtttctctatacttagttttaataaacataacagtttattgagatataacttatataacatacaatccactcttgttatgtgtataactcaatgacattaagtaaatttagagttgtataaccatcacctcaattcatttttagaatatttttgtcaccctacaaagatccttcatacccttagggagtcaatccctagacccagacaacaaatattttctctctctataaatttgccctttttggatatttttattaatgcaatcaaataatatgtgatctctttcatgtagctttttcacttatcataattcatttttaagattcttttatgttgtggcatgtagcagtagtctattcccttttactgatgaatactattccactgcatggatataacaccacattttatttatccatgcatcagccaatggacatctgaattgtttccagttttttactgttacgaataatgctgccatgaacattcacataaaatacgtctctgtgtggacatattttttttcctcttagatacctcaaagtggtattgctggatcataagggtaagtttattttaacttttaagaaacttccaaaccactttccaaagtgactatactcttacatctcccctggtaatataggaggcttctaatttgtctttatcttccaacacttgttactatctgtctttattacagccattctagcgggtgtgaagtagtcttttacggttttaatttacttttccctggaaataataatgttgaccatgttttcaagtgcttattaggcatgacttcatcttctttggtgaataacttcggtgaattgtcaaatattttgcccagtttttagctgggttgcttgtctttttattattgaagaattctttatatattatgcgtaaaaattcttatcagattatgatttgcaaatcgcaatcttgcaaatattttcgcctgtctttggtttgtcatttcatttctttaatgggtcttttgaagtgcaaaagttttaaattttgttgacatcctaattaccaaggattttattgaatcaagcttttggtgtgatagctaagaactttttctaacccaaagtcatgaagattttctcctgttttcttctagaaattttataattttagctctcacatttaggcccatgattaaatttttgtgcaggatatgaaataagaactaaaatatgttttttacagtcctaggttcgtgaatattcatttatatcgcatataatcctagcatcaattacagagcactgcttattgaaaagactatcccttcccatgacaaattgccttggcacctttgtcaaatttaattgatcaaaaatatgatgaattttctgaactttcaattccattccattgatctgtatgccaatatcatactctataaagtaagttttaaaaccagaaattgtacgttatctaattttgttttcctttttcaaaagtattttcactattttggatcttttgcatattcgtgtaaattttaggattagcttgtcaatttctgtaaaaacgcctttattctttttgacaggattgtgaattgaactgttttcttaatttcattgtttgttgctagtatacagaaatataattgatttctgtacaatatctcttcttatattcagttaacttgttgaattcctttattagttcgtgtgtgtggtgggggaggtgtatgtacattgcttagaattttctatgtacaagattatattgccggcaaataaatagttttactttttaatttccaatctgtatgccactgattgtttctttctgctggtctgtctaacccttctctttcccttcccctccccctcccctgcagctgctgctgcttcttttttttttcctctaatttgcttctctctctctttcttacatgtatttatcattctgcactggattgaatctcctgtacaatgttgaacagaagacataagaactgacaaccttgcctcttttccgatcctaggagtgtatcggtcaggttttcatcattacatacattataagttcttcatagatgccctttgtcaggttacagaagttctcttctattccttttgttgaaagattatatcacaaatggatactggattttctcaaatgtttctgtacatctattgaaatggtcatgtgttttctcttttattctattaatatgctatattgcattaattaattattggatgttaagtgaaactcacattcctgggataaatcctctgtggtcagcactgtataatgcttttctactttgccacatttggtttgtgaatattttgttgagttttggtgtctatattcatgagggaatctggtctgcagttttctttcattgtgatgtctttgtctggctttgctctcagtgtaatattgtacaaataattgaaagatgacctttcttgctctatttctagaaaagtttgtgaaatactggtattggatagaattcaccagtggagtcatctacatctaggattttctcctaactataaattgtataaattgtatgtctttttattacgagtctgttcatattttctatttcctcttgagtcagttttggtaatttgcgcatttctaagatagtccattttatccagctaattgctaacaattgtccagttgctaacaattgtctaattgttaagcaatgacaattgaggtcaaccaatgatcagtcacaggttgtatttctaactatcaagcaatgaaaaggattatgaggttataatatttgttcatagtatagtatgagatcaggaatgagagagaaggtatcaccaccaaccccatagaaatgagaatgattatgaggttatactatttgtttataatatagtattaactataactatacctcataatccttttcatttctgtggggttggtggtgataccttctctctgattcctcattttggtaatctgtcatcttctctcctttttccttgatcagtctagcaaaagaaaaactaagttttggttgatcttttcaaaaaactaagttttggtttcattaattttctctattattttcattatctatttcattgatttctgttcttatctttgttatatccttccttctgttcaaacagaatttagttttatgtttatatcatgtctatacttacctaaataatgacgtgatgaggtccttttgtttaggtgaattttagatacatttttatcatttcatttccacttaaaggatttccttcagtatttctggtaaggcaggtctactagcaacaaattgtctcagtctttgtttatttgggatatctttattttatatttatttttgaagaacaattttgctaaatataaaattcctaaatgacattttccctttttttccttcagcacactgaatacgtcatccctctacctcctggctttgtttctaatgagaagtaagctgttaatcgtagtgttgttttcctgtatgtaacagtcttttttttcttgttactgtcaaaattttctctttttcattcaaaagtttgactataatgtgtctatgtacagattttttttgtgtttatccaacatggagtttttgtgcttctcaaatgtgtagattaatgttattcatcacatttgggaagtttttggctattatttcttcaaatatttttgagccctttctttctttcctcctcttctctaccattacacatatgttagtatgcttgatggtctctcacaggtctccgaagctctgctcattttttcattgttcttttctcttcaaattagaccatttctattaattgatcttcaatctcattgtgtctttattctgccatcttaaatattctgttgagattctcttgcaattttttaatttccattataatattttttaactccagaatttttgttccttttaaaataacacttatgtttatattgatactctctatttaaagggtaattatagtaatactttaattatttaacatgatttcctattattttgaacatatttataatagtgctttcaactctttgtttgctaagtttaacatctgctatctccacttcaacccaaatataatttctttttttttcttcagacactttcttttaaccacttcttaaattgggtatgagtcacactcctgtttattacatgtctcatttttttcttgaaaattgacattttatatagcatattacagcaactctggcttctgacttttccctgttgagggttgttgctgttattgctgtgtttgtttatttaggacttgcctaacataactctgtgcagcctctcttccccatgctgtgccgctgctgatgtttctgctcagtttgtgtaatttccattttcgtttttgagctgggactttcccctgtgttaacacagtttagtggtcagccaacgatcagtcacaggttgtacttaaacacctagggccactatgctaacgcctctaattgatatatacgtgtgtgtgggttgtagaatgcactcaaagttcaggcagtttacaagtgtttttttgatttttactttccatttgttctctcttatcttctctctgtgtgtccaaagccttaggtcttccccagagtatgtgtgcagcctttcagacctctaggaatatgtggtagcttaccaaagttcactatgatagtatccttttccaattctccctgctaaatttctggccaatctgccagttcttttctactctgaattgtaacttcaggctacatatgatgtttattctccctgcttgtttgcccctgagattgtcactgttttgaccacacctaagggcatggggtttttctatgttctgctccatcaaattatcgaatcaccccctttcagcagtgaagttgtgggttttcatgacttgtcctgccctggcagaactactgatacaatggaactgtggggacggataataggaggaagcactcccggctaaaacactgtgggctcctaactgtgctagttgtcccaacataacttttaatttggccactttcactcccaaaagtatccagcttctgtgatatgatttatgaccttttaatctatagtgggcataaacgacttatgccatatgccatttcttcagcgaatgaccactgcctaattcttttcttagtaatgcaggaatcaggggcctagctgcaggtatccatgcatgtggggtggcgggggggaagtctaactgccattgaatgaacgttttcataatggttacatgtgtatagaaaatcttcaactgcccctcctactacatctctagaaagtttaaaggtttgggggggattaagaatttctagggaagtgtatgggatatagggataaggttaccaaaattctcccatgggagataaatagttttgcctcactctatagagtttggagaaaccactcagcgagaaggactagaattactttggttaataatgagttgctatgaactttggagctggactaacctattctaagcaattgtaaagaatatgtcatttagacttaatcttatacaaaacaataatagctcagagatctaagcaggtccaaatacttacttggatcaggttagtatttgccagcttattttctcacagattcctgggctcactcaggttatacttccttgggaacacacaaagggaataagctccttttggaactcaaataacttgtaaatcagaaagttcccatatggatatagagaataatatttactatataataatttttcctttacatgatgatccacaataaagttcccttgagaatacacttccctagagcatttaaattatgaacggatttacaaaataactcctatcacatgaaaagagataaacatatagtatctgcttctaggaattatctaaactcattttccttcagagacttaaatagatgaaaaaaatcagcaaactttgtttaggaaaaattcagaatgtataaagcattaattgtgaatatcttactgatatctttggatcaacataatacttcacttttacaacatgttgaggaaatcaaagtattcaccaaacttcatctcattaaagtgtcataacctttaatctaggaacccgtaatagtaaagattactgtttctgtctggaaaacaagaaatctaatccatgaaacaaaatcctgaaacatcacatacattgcttaaagatgtaagtctgaggatggagaatgtgatggaactccgtcaccttgttgtataagtgtgtccggaattggtgggttcttggtctcactgacttcaagaatgaagccgcggaccctcccggtgagtgttacagttcttaaaggcggcgtctccgcagtttgttccttctgatgttcggatgtgttcggagtttctgccttctggtgggtttgtggtctcgctggctcaggagtgaagctgcagacctttgcggtgagtgttacagctcataaaggcagtgtggacccaaagagtgagcagtagcaagatttattgcaaagagtgaaagaacaaagcttccacagtgtggaagtggaccccagccggttgccactgctggctccggcagcctgctttcattctcttatctggcgccacccacatcctgctgattggtagagctgagtggtctgttttgacagggtgctgattggtgcgtttacaatccctgagctagacacaaaggttctccacatccccaccagattagctggatacagagtgtccacacaaaggttctccaagtccccaccagagtagctagatacagagtgtcgactggtgcattcacaaaccctgagctagacacagggtgctgattggtgtgtttacaaaccttgagctagatacagagtgccgattggtgtatttacaatccctgagctagacatagtttctccaagtccccaccagagtagccagatatagagtgtcgattggtgtacttacaatcccttagctagacataaaggctctccacgtccccaccagacttaggagcccagctggcttcacccagtggatcccgcacccgggctgcaggtggagctgcctgccagtccgtcgccgtgggcccgcactcctcagcccttgggtggtcgatgggactgggcgccgtggagcagagggcggtgctcctaggggaggctcgggccgcacaggagcccacgtaggtcgggggaggctcaggcatggcgggctgcaggtcccgagccctgccccgcgggaaggcagctaaggcccggcgagaaattgagcacagcagctgctggcccaggtgctaagcccctcactgcccggggccggtggggcaggccggccgctccgagtgcggggtccgtctagcccacgcccacccgggactcgcgcttgcccgcaagcaccgcgcgcagccccggttcccgcccgcacctctccctccacacctcctcgcaagctgagggagccggctccggccttggccagcccagaaaggggctctcacagtgcagcggcgggccgaagggctcctaaagtgccgccaaagtgggagcccaggcagaggaggcgcccagagcagccaggactgtgaggactgccagcacgctgtcacctcttataaggttatcaatagggcaatatccaggctacaatgaaaaagaaacttgaagtctcgaacacctattgtgtatacattagagtggattcaaaataaatatttaaacagatttctgttcctgtggaatggtatttttccagcaaacctctccagcgattgtttttattaggctttgcaatttctataaaaggatatcaaccctgtcccaacttcattactatttctgctattaattaacaataaaaaaaataggctaggcatggtggctcacatctgtaatcctagcattttgcaaggctgagatgggtagatcacttgagtccaggagtttgagaccagcctgggcaacacagaaaaatcctgtctgtacagaaaatgcaaaaattagctgcgcatggtggcgcatacctgtagtcccagctacttgggaggctgaggcaggaggatagcttgagcctgggaggcggaggttgcagtgagtcaagatggcaccactgcactccagcctgggtgacagagtgaaaccccatctcaaataataacaataacaaaaaatagttgtatttcaagtaatataatctagataatctaatataatataatctagataatctagaattcactgtcattcaatgaattatatctgtgtgaagtgttctctatttggtccaaatcttttaaaaatgggaatactaaagttcacagtaataagatgttgtcagtctacattgaggactacaaagaagcatttctataaaatatcctttgttgctaatgaaagttaatatttatcttgatatttacattataatacagtgatccctatacatactgaagagcatcctagaaaattgatttttcttagtataagcattgtatttctttaaaatatataatcagagcccaatctgtaaatgtaggtaagatcctttataggatgctttttaaatgtaggtcaaattcttgcctccttctcatgtttttccactgtttacccattttattttttatttacttaatttatattatatatttcacttactgtcatttatatttatataaatatatttatacataaatatatttatattgtacatgtatgtatcatttaagctatctcaatttctttttgtaacaaagagatatctatctgtctctactgtatatttgtctatctacccttccatgtaacaattcatctaaatttactatatgataccccaacatttcagatgcaatctgaaaatagcaaccttagatcctctataaactcatctatgtttttgtggtgactttagttttcttctaccttcgaagctattcaaatcagaatagcctcaaatctgccttaaacttgtctgagacaaagtaacatatttgtatcatcagagctcagtattaacttaaagcttaactaaccacctctttgctaagtcacctgaagatgattcttgcctttctgtgcacgaataaaataatttgggacctatggaacaacaccaaccattttcaaataactaataaggcatataacatagagcagacacaactgattatatagtttgtaccctgtccaaggcacctagtccaggagtgtgtttcactcaataacccacgttccctagcccaagctgcatctgcttgagcaaagggtttcttttaataatttgcacaaaggtgtccgaacaggcagcttttttctaagttgtattgaaactccatatgagataagaaaggccctctataacatgtttctatagtacttctaacagaatataattaattgtattaatattagctggctctctagctgttacatgtaacataaatattcaggtaacttcctagtaatgactaacctcatgagcttaggtctccatgacttgcactaaagaatgctttaaaaatagaatgttaacaagttcggagacatggattatttgtacaataaaatacttttcttttaaatttagcttctggctcccattccttcaggcagattttatatattagtagttaagtcttaatgaattatctacaggtaggctatacataacacatttttacattaacttttcgtgactatgacatgaatacatgcccattgcaaaaacaaaataaaacagtacactgaaaatatagaaaatatgaggaaagattacgagcatcaatagtctgatgacacagagacaataaaccactactggaccttcaggatttcattccaacgtgacacattttaatcccaatttggcttacccattttcccctgcacacaacgagtagcctcctatttttactatttggtattgtgcttaagcaacggaaatatttcaagtatttctatagcaattgttttctataaaattaatttagtaattgatcaagtactatcatatttaatagccctgcaattgatcattattcatgatactactcattgttattgcttattacttcatgaatttggttttattcaatcatgtcatatggagattttatacacacacacaaaacacgcacacgcacacacgaccggctactacataaatattaaaccatttctccgaaataatatggaggttagaagtagcttctagatgaacaaaatgaaatggcaaatttgatgcttaaaagtcaaaaatttcatatcaatgccaaagatacattattttagataacactctttttctttatttttatttttactatctttgctacaacactacaacattaatatgaagaactgagagtcagctacgcctataaaggtaaagtgccataaaagccccaatgcatctctctcaagagtctaatcttattctatctgaggagctatcctctttctgtgaactctgtcatgtagaattacatcatctcccatggctcagattatctccaatttataaaatgctttaacaaaaactgttacaaagtgggctctgttatatattcatataacttcctcttcactttggttaatacggaaatacacaatacatcaatatgtttcattaaaacgattgttttgatatagtaataagctgggcaaatagaggaagtatgctgggtgcaatttatttacattttaataagacctcaaacaaatgataccacacaggaagctcagaattaggttaaggagaaatggtggctaaaaaatgccttgaagtttggaagctgtaagtattatctaatcaatagtattacttttgaattaagatagaataaccattccacagggacaggtattgtggtctgtgacaaacattattcaatgcagacattaaaaatttaggggagatagaaattttcaaaatttgataaaattttaagactaaaccttagaatatatgccaaatgctaaagtttaaaatgaatgggcctatgaaataaaaatctcatgaaagcccaaagtatgggagttttcttccttaatataccaaagcttactgctaaaatccccatttaatagagatgataacttcgccattcacattttgggtttctcctactatgcatgttaactctttgtgaatagttctaaaaatcaagacaagtatgtactttaatcaaataggagattcagaaagcaatgatttcagtctacaattatagtagcctgcactattcctatttccaaactctgagcaggttcacctttgtttgagacaaattatcactgataatatcttacagattaatgtgcatgacatttgtctatccagtgtagtttccaagacaataaaaaaaattgcagaagtaaatatattatttaagctgcaagtgaagaaacaattataaaagtacaataatgataggaaaagcatgaagaggacagggtgaggtaaatatacaaaaggaatcttgtaagaactgacacatttgctaaaagaacaagaatatgactccgtgtgtgtgtgtataaatctctctctatattaagtctatatgaaatatatttatacaacttatacacacacacacacacacacacacacacacacacacacataataaattgggcgtggtggcttacgcctgtaatcccagcactttgggaggctgaggtgggtggatcacctgaggtcaggagtttaagaccagcctgaccaacatggagaaaccccgtctctactaaaaatacaaaattagccaggcatggtggcacatgcctgtaatccgagctactcaggaagctgaggcaggagaatcacttgaacctgggaggcggaggttgcggtgagctgagatcacactattgcactatagcctgggcaaaaagagagaaactctgtctcaaaaataaataaataaataaataaataaataaataaataaataaatatctctctatatatacacacatgcagaggcatacatatatgcctctataaaaataaatatttcattaggagttttgcaatttccttatttgtatctatccatgaactagaaagtaagttccttgaaagtatgacttatgttttctgtgttgtaattcataataactagcatgatactgagcagaaaattggttctcaataaatatttgtgtgaaatacaaaaaatctaatttcattcatgcacactatgtaaaagaacaaaattaaagaattcccaaaaataagacaaatgataccattacatggggaaagcaagttagattatgctacactacactaagccaataaaattaataccaaaaaaacccttcaagtgaaaataaatctatgtaaatacatgctgaaatcctcagatgattcagactccagagaaatgaaaccccaatgacagcatcatgaaaatgagttgccccaatatcacatatcgtttttgtcatactctacaagaagtggtcaggtgtgattagaaattccaatttcctaatcttacagaatataaacaatctatattacataagtctatgaattttctgaggcattataaacttttatggacattttttattagaatctgaacacaatggtgtttcaatataaaaactcataatttcaattgtgaatcaccattttacatttaaacaattttaaaaattcacattgtgacatgttataccattaggttattaaaaaaactctgaaagttttcttaataagatcataaagttttttctagttatgcaagagcaatttgatagtggaaaatcaattatgctaagtcctttgctgaactgtcacatttcaaattatcctataatgttttaaagggaaagggctatgcatcttaatcccaatgtctagtgaacaatttctggcatatagtaagtgctaaataaaatgtatgatgaattaatttgagttgaaaaatacatctcaagaaaagtctatgtccatgagttacaattggacaatatttaccagaaaaaaaagattaataaaagtcaacgtccattcctaataatcaaataaggattcagaaaatagtatgttaatccactttaccaatatatcaaataatatctgtcttaaatcaacaaccaatatctgccttaaatatgaaaaaaaactagagataataccacataataaaaaacaagaaatatgccctctaccacaacgattacttaactgttttggaaattatagtcaatgaaataggatattaaacaggaataagaaaggaaatagacagtcatctttgttaggagataatttaataactttgaaaccccaaaagaacttaaaagaaattattaaaactattaagagagttgaataaaataactagataataaatacagatagtccccaacttacagtggttcagcttaagattttccagttttacagtgggtttatcagaatggaaccccacataagttgaggatcatgtggattataaataggaagtggcttttctaccaaagaattataaatgaaatataggcaattaaggacactaacaagaacatagcatgcctatacctaaatatatgaaggaatttggggatctatatgaataaaaagatacaatctatttatgtatgaaaacatactatgcttctgaatgggaagactgaatattgcaaagatactaatactgatttataggtttaatacaattccaacaaatattccaatgaaacatttttatgaactcaacaaactaaacaaatcctgactagtaagtaggtgacaaaagccaaagcatttttgaaaaaagaaagataaggaaggattttacctaaaagatacacaaacttattttgaagctctaatggaagcaatatagaaccggtgaaagaactgaaaaagcagatagtccagaaatagatcctaatgttgataaaaattagtaggcaatcaagatgatgtcaaaatcagtggggaaatgattctggaacaattgattaaccattaagaacaaaagtaagtaagatgtttacatcataacatgctaaaataaattctgggagaaacacaattaaaaatataaaacagaaccatgatcatactagaaaaaatggtgaatatttactaaatttcaagctatttaaaaaagaagataaaagtaatgaacatagtcacagagaaaaaaatacacaagaaattgaccatacaaatatttaacattttctcacataaaatcttacaaatcagtaaaactacatgagtaaagaccacaagcaaacaatttataaaaataagaaaacaatgacaaacatgtaaaaaacattctagttccttattaaatcactgcaaattaaaactatgtaaactagttattttgcctgcaatttgtcatatatttatataatgctgctattcaaaacagttaagaatgtagttagaaaagcacttttacatacaattggagaagaattctcaaaggaaccttgagaattttacatcctctagcccagaaatcaactttctaaggatgtatgctaaaaacataatccaagatgcagataaaaatttatatataaaaatgatcctcagagtaggagaaataatagtggaaaatgacctaaatgtcaaacatgaaggagttaattaaaattttttggtacataattaagatataatattacacagctaatgaaaatgagtattttatgactcagaattaataaaattaatgctaagtgaagagatcactatacagactatacaatccaaaatgttgtttagaaatatgcaaacaaacacatatatataaacacctgtacactttagaaacacccatacacttggaaagaggcagagcaaatacttagaattgtttatccatgattggtggtgtcaagtgatttaaatttattcgttatatatattttctattttgacacatcctttcaacaagtgtacattaccttttaatctggaaaaaaaagttattttaagcctaaaatgaatttatgtgggttagaaattcacttaagggaaaaaaatcagataccgataaaaatcactttcatatacatgtagaattactgtgctctttaatctgtgaatctccatacttttgtgcataaagaacatctattgagatattgagatacttgacttttttttagtgctgaagaacacaataattttcctgaattaaaacccaaagaaaataaagtcactcataaataccatatttgactacagcattcacccaatgctctgatggcctttcccgttgttgacttattgataaaatttacctacattgctaatattaataattgttttggtaccaatttcaggaataatcaatctgagaatgtttacttggcccatttagacaataccaaggaaaacacccccaagtaactgtaaccagcatagtgaacagtgtatttgcgttttcacatttcttttccatggaataccaaccttgcctagtattttgcgaataacaatggatggaacttggattttcaacagtgcttaaaaaatagctgccaaagtcaagacatgtaataaccttctaagtaagtttgctggctccatattgtgtttgaaggcacaccccctccaaacgtctgcagtcaccatctgctactcaactgcagaataatgcactgaagtctggtgttgtttggcatgggcaaagacagccaatgtccaactccattcagacatgtgcaccatatcaggaaccttatgacacagtcctcaacatcaatgcagcactttcaagccctgctgcacatcaatcaagtatgtatgacagtcaagctgatagataaaatctaagccaactctaaatacctactgtgcatggatctctctagtttgcctgcagctcaccttctattaagatgatagctttggcctagtcttccatgccaaaataagtgcatggagtcactctggcaagaagaagcgtctacatcaatgtcaacaaacaagttccttgcgcccgaccctaccatctgtcctcctgcttcccacctaccgtactttatgtggaccttgatgaatgagattctaatagtccaagactctagtttagccagcctttgcagatggggtcaacatgactgccctctggccaaatacccagggtgacatagctgatgggttacctggaaagtgcctttttgcaaatttaatgtcagaaataaagcaaatgaaggcgttcctacaggttctgagtttcgggtttatggaaaaaagtgatgcattcaatgcttaaagtgaagataatttttcttttaaattatttgaaaatcttataatgctaaagcattgataaattccatttcaacactacgggtaagggaaataaaatgaatgaataaaagtaaaactggggctattctaatgtatttacaaagtaggtttgagagaaagacttgaaaaaaatctcagaaatatgtagaaataagacttgatagtgtaacattaatatagaagcagattatttcattctgcgttagatgcaacaatattagagcatattgcacatgctaaatggggaataatagatttcatacctattctacagaagttgtatggcacttgcagatttcaaggtagagcagtaaaatttaatataatcttaagtatgagatataaatagtttctggaaaaatctaattgtttttgccttaaaaagatattacatgaaatatgataaatcagtattgtcataaaagtagtaaataaaattattttgttttttgaacatgttgacaaaccatttcaattaggtcattaaaaaaacacttaaaatggagcctgagggcatatgaaacaaacagaaatttcaggaaatgccgctagttccaatccaactcaatttaataggatgatacaatgataagaccttatttttccttcaaggaaagctaaatgtatttctagaatggtctctggacacatcaaaaatagaacaagcaaaaacaaaacaaacattctacctaggaaacaacatcatctgaaactctagacaatttaagtaataataagaaagtgaatcttcaccaaatgagaaaatgaatgtgaaaatatgttacatactataaagcaccatacacagaattattcagagcatctattaaagtgctttgtacatagtaagcatttactaaatgtttgtagaattgactagaatttaattgaaaagagaagtataatgagacttctacaagtagaatcagatccttttaataccatgggaaaaagtttcagtcaaattatatgactaggtacatccgttgtctttgatgttatgaatcaagatgagatcctattatatcaaaagaaaaaatattgttgaatttctctttggagaaatcacagtaaaatgaaaaggatgattatttttaatttctaaatatctccaaattttatagcattcttcggtcaactaagataatgctatagaaatcctacataaaacttgaacttacaatgtcctggcctaatcatctggctaatctctttgagttttcctgaaatatgttcacatcccattttctatgggaattctcccactgattaacacagagaatgagaatttggcctgtgctctataggcaccattgaaatgtggccacctgaggcatgtagggagggcatccagctggcacaccacatgttgccctggagtagtgtacaatgagagggatattttggctaagaatacctggatgatctctataaaggtcctgattatgaaaaggacttcagcattatcattgtctcatgggcataatatgagccagggaaacttctgtttctaagttcatatattttccaaagaaaggacttataagaatataagaaaaaatcaaagaactctatgaaagagaaacactgggccattgatactagattttatgtactatccatatcactagaagaaacttttttgagagctccatgcattttaaaacttatgctaaagcacactatagacttgaccatcaaataaaacataatgaaatctgtaaaataaaggatgcaaaaacatagcgtgaaaatttatgcctgcagtgcagttgttgtactatattttataaaaatcaattaagttcacatactactcacttaagaaatatctgctgattttatttttattttacgcaacttgtgaggaagaaaatccatgcatttgaactgtagtgccaataaaacaattttgtcaattttgagtctatttttttcaaaacaccatacgtgattaaaacacataatgcactagtatttttgccaaattttgtttttaaaccaaagctgtttttgaattacataagcacaaaatcagaatttcaaaaccagcaaacatatttaggggtgaattttaaaataagcccacttgattcattgttagacaaactttgagtgccagggacatttttgtgaaattccactggggtaaatagggtagctaggaaacgctcctcaaagtgaaaaataagtatatgcattattttcaataagttttgtttagcattttcaccctcatactaagtggttctggtgatatttacaatacaacatgagcataaatcttaaggaatttatgatgtcatcaaatgctaagagacaattacagctgggttttacatttgtgtttatatgttattttgcatatagatcccaaaaaccaatgaagagaaactttgatacaaaacatatcctgaaactaaaagacagcttctatctatcaatataaccagttgatagtatttctaagacagagtttgacagtaagtgaaacaaacaaacataatgttttaaatatgccacttcagccactccagctgtcactcaagaggctttttttaatatcattaattcaatgccacacaaacaggaattcggtctttccaataaattttggtgacaacttgttggcagaaaggaaactaatatatatgtggaaacttttattttgtcatcatgtatgtttgtttgaacttgcttaaaatattgtaattgtgggcctaatttacaccttttttcctaaaagctcaaacaaatcacaatgatcacagtgtccctaagactaatgagtcccaatttataccacagaaaatagaagctcagagagctaaagagtactggcagaatattatactgcaagaatagcaatatagcaagtatactcacttgaaatcctaataaaaccataaaaactaccactttgtatttttcattagcttatatttttacttaatgcaaaatattttgcagaaaagttttctagctagctttattgctagtaagagaataacttttattaattgaattaatttttgtaatttgtgaccaatgaggtttgactcacatcgcacattttctttaggaactcagatacttcatagatcttaataccctgatgaaaatttaagtcctaaaaggccaggaaatactgagattcaagttggctcctctaccatctttactgacagaaattcagagtgccaaaagtcagcactgctggttgctgatcatcatatctaaacattgattcttctaattgtgtattttgagacttgcttgattttagaattacaggtggaaagtcacttctctttgatataaattgcatgcaataaagaaggaggcagtcctacacaataaatatgtaaggaatggttttccacctctgcatgctgcagaaaatcccactgagttaagtagggttctaccaaggccacttaaacatattagcctattatgctccacatttctttattgttctcaaaaagctaatgaaatgttccagtgtaatgttaatgctggagtacttttaaaggcattttagaagtgatgtttctctcataactccagaagggggttccacttcctaaaaacatttaggaggccatggggagaccatgcagcctctttactcagactgtttagactcatagctggagaagaaaatccttaaagataatcacttaagagtttcggtgtgagctatagcatcatcgcaaagcgacaggaattaaaaggcagtgtaccgtactactgaatagataggtttaaaatactgtgtactgtctattcacagataacattgatttacgttggtaaatctattggttcagcacatcagtgcagtattaaggaatcaattgtttctccagagtcaattatttttagaaaaataaggaaatgtgacctatcactgaaagtcagtatgtagaattaaacttggccagttttcttcctcgctggggtcttaattttttcaactgtaagataaatgaatcagacttgtcagtatctatgatcacttctagcattaaagttttctagttttaagattctaaataccaacactgtatgttgaggaatagcaaagtaggaaaagaactgggaataaaactatcactgaattattaactttccaacaatcaaaattctgtaattttgcctttagttgccataaacaaccacctcaccttctgaatatcaacaataatatgaatgaaggaaaggttgtatactaaggtcacaggtggtatggttgagattaaagccaagactgagagtatagtaatgaattgagaaatgaatcatacacttttgacctaatatgtaatatgtcttcccaaatcgtcatttttatacattcattttcaatggaaaacaacaacttgaatatcttagaggttttttcccccaagaaagacatcaggctgtaatctccccccacaaaatttaatacagttcatagctcatacccctaccggataatccccaaaatgtcttgttcctttttcaaattagacatcagcattcagtataacaattaatcaatgccaacaatgttccatatgctttattagcattcattcaccgaatccttccatgaacactaggaagtaggtactaataaaaacagaaacaattttgaagtacagaatctcagaggtggttatcagtaattctagaatatcagtctgacatatgggtccctccactttttttcagtgcacaacgtgaacactgtgtggcacagtgtttcaagaattaatgtttgatttatatcaaagcattatgttttttacttcatcttaatagtaatcacaagagtgacttaagcctcctacatgaaagcagagatagaaaaaagatgaccttggaagttacatattttcttttcctgtaagtatgaagacatgtctataagttattagaaccataaaaaaccaaaaaactaataagaataaaattgtgaaagaatattgaaacctccttaataagcaggttcttgtaggatattgaacaaggtatgtatgttgtagccctgatgctatatttgtgtcatgctgagcaagctacttaacatttaggtgcgtaagggtttttttccctaaagtgggaggatttagatctctaaattccttaccaatcataattttagagcaaattatctataaagtcaattaataatttgccttgcttcatgtattacataatagttgctaatcaaaatgaatagtattatactcacagctttaactaacttatagctaagatcaggcttgctttgtaaacatctctctaaaaactcagaagtccatgaatactaagactttttactcctcctgtaatttttgacctctactggaaatctcacctgctacccctgacctcgaatattgcaagtattaatacagtttctgtatatagtgtacttaagccaaaagtcagaggcatgagaaaggtaaaggccgggacaaaggtactacaattcagctacacacttgtaatgcttcccattagttcgttagttatattagttccagaaactattttaacacggtaggctgatactgcaagcaaaaacaaaaatcatgagaacaatgaaatagtaggtcttagcgcttaagcatatctactagtagtaatacttgacaagcagcccaccttctttgtgatctggaaatgatttgatgataaagccaaattctagaaatataactgctatcttttgggagatcaaaggtcatgtgagggggagagctaaggtcaagagcaagccccttaagcctactccagaaatttcactagagggtgctcttgggctttcatgacttctcagttcttcaataagaaccaagtattgcttagataatatattctgcctagtataacttggactccatcatggatcccatatccaatacttcaatatagaattaaaagatatctccagcagaccctgggcctggttttttattttcctgtgtaatttccttgtttctactgatagtacacttgtgagtttcacaaatttaagacaggtaagagatcttaagaggtctccaaaagtctacattctattaaacaaccacagaaacttcctaatacatcaaagtaagattaaatggggattaactgataaatctatttttgcaaatatatgttttacaaacatattttaatcttataataggttcataatttatatacctattggaagaattattattccataagatctgtagagaaagtctgattgtcaaatagaataaatttcaattatttatatatgtattattcatatgtctcatgacatcaaatattgagcaccaagtaagtactgaataaatatttcttgaccctttattgcacatacatatttttataacacgttccaacaggatgacatataattaaattttaatctctacaccatatgtttgaaattttttctataaatgcagtttcacctttctggaattcacgtttaatgacttattctgtttatttctaatgataatcgctttttatatactttccatttttgctacgtttttaagagaaaatgaaacatggaaattgttttgttatgtgattaactttttaatgtttctatttgtttattagaagattaagaaggttatttatttctacattaaaatattggcaatggcatatatcaatgcatagtgattttcttaagaattgcaatgagtgactcagtaaaattcttcttcactttcaggatgtaaagaattatggctactagccattatgcagggtgatgttcttatcacacataattgaaaactcaatagttttagcatctttagggttgacagtaaaattctgaggttgactatggaatgctaagtctttgaaggcacttccaatttggctaaacttacagtttcattattccttaattgaattaagtttaagtttctcttaaaatcagcttgaggcttttgacaaattagaaatttgggtcctgaatagtagccctttacaatatatgaatctgcataaagatgtgttttaaatgcctatttgataaaaagataagcctggtcacttatggattctagctcctttcaacatcctgcatggattgcaaccagtgtgaaaaattggggatctttaaagtggtctcagatctcttataaagcagtcacctgggctcttaaactgtatggtgcttctcaaaaagggctccttaagtatcctatctgatgtatgttattccccaattcaacttgcaaaggacagagtcaccagcatatattcaaactgtatttcatccaagtgggttgtcaataagcttaaatcactctatgaagaactggcaaaattcccatggatactgtgaaaataaagggaatcaatgaagagatataattattttagtctcagatttaattaatttgtgggagaggtcattttctctcaaatatattcaagtttcttcaaacacaggtcaatgtttgccagctgataggaaaaaagaaaacatttagtctgagtttcccacgtttatattaatctctgtatcacagctaaataaaatgtttcataaatcttcatataggcaaaagagagttcaagctaaggcagagtaacaagtattgccaatagaaaataacctcttaagtactgtttctactatttcctgttctaatttttctattggagagaatgaaacaaagtaatttcacacctggttttatgaatcagctcactaaagattctaggtagaagttacacgggagatgcaagtataacttcattattttacaattagaacactaagacaaagaaagaataaaagtggcgtgctatcccatgccatgcagttagcatatggcaggtcttactcagagtccccagttcctaatctagtgttctttctactgcaaaggtttccagtgctgcttggtttttcataaaggatctgtatatcatgtcaaaatttcatgttgactttccttgaaatttcagagaaaaagaaggcagtataagaaaaattactcttcattgtctaactcttcaagtcagacagcattcctatgtgcaatgatcctcgatacagtctaggtcaactgatctctatgagttttcatactcattaaaatgtatgcatcacaaagtacaattaatgttctcactgactttagggaccttgcatgtttcatccgttccctaacctatgccatcctgaatccaagaggcaccctgtatttctctgaaagtcagcccagcatgaaaatactgaaataagagtgcaggtgtactctttgctttaagaagacacaataagccaaattctgaacttaccaaacagacaaattatggggtgattattcacattttaaaaggattcaccacaggatgcttttaaatcataagctgctctattgcattttaaataagttgatttataaagcttcctttacaaggacttttcactatccagggttcatggttccttatccaaaggcaatgagagcttggtgagcataaagtcctattacctgctaagccaagcttcctttcccaaataagagaataattaggactgtagttcatttttgaaaaattaatgagtctctcactcctgaaaaatttaatataccctgagcacttattatgtgcctggcacagtgctaggcattttagataatgatcttatttactcctcctcaccacaactctaggagattagtacaattatcccaatcatggatgaggaaactgggactcagagaagttagagttaagtaacttgactaaattcttgcagcaaataagtgatcgtgccaggattcaaagtcagatctgtctggagctcttgcccttacatattttacaatataatttcagatgaaatttaatgacgtctcttacctctgacctaactgagcataattgcgctccaaatgtactattccagtgcagcaatcctgtctgtagcaatagggaccagtcacacagcctgaatacaaaaagatagggggctcactaacaaggttgcctattctggtcactgcactgccatattaagcccggatttatctcctgcaattcctacctattggatctaactttgctctacagtcattgagaacaattaaaatcccttccccccatacctatcatatttctcttatggtttctttcttctttttttttttttttttttttttttttagtatccagtgcctccaacctttttaaaatataatgggtttatccgctatttacatatattttattctttcttgaaactggttcttctggagcacagagaacttataaatgctatttctaagcgtttatgcaactaaaaattattggaacaatacacagtatagtggataagggcgcaagctcagaaacccagactgcctgggttcaaatccaggctttaccaattaatggctcgatttccttggtgaatatatttaaagtctctgtgcttcagtttcctccttcaactatgaaatgaggacaacagtacctagttaatgtggctcttgtgaagatttaaaagaggggcaatattaagcaaaaggcaatataaggaaaattactctacagtgtctaactcttcacgtcaggcaacattcatacagcaatattcatatagcgcttacagcctgctaggcagcaattagggtactgcctaggttgtaagctttatataaatgtttgtcattattattgatggtataggagtgaatgaatacttaactgccttggaaaaatatgacctatatcattgtatgagattgattttattatccagatataaagaagtcaagctcaactagaaaaggcacttgactggagaccagagatgtgcttctagtcccaactctttcaaacactccagatgaaagatcttggactttatctacctcatctttttaaacagaggaatgggactgtacctctgcctctaaaatgatatgtttttattctaggattctaggatcctattccacctggaccctgcttaaatttcattactcattatgtttgaaaactaccattacatactaacattttatctgcatgtttatatctgttgacatttcaatcagcttatctgcattgttttcacgaaacagaataagcctctgagagtctatagacaggtctgaaaaaacaaaaggtgttgtgatagcacagagaggaatttaatgtcactttggaggaaataacctaaagtcctactctgccaagccagtaaaatcctgtcctctgcctgcaacacctggcccagtccatgctatcttgctgaatttcagtgcagctctttggataaactcaaattcaggtttggatggaataccaggttgatacaacagtcattttttttcaacagaagtgcaggttggactaccttttacctaccaaaatcacctcattctttgatatatagaacatttagctaattttattatgacttagtatgccagtactcctcatatactttattgtccatccccagatctagtgaaggcatggtgactggtatcagtatcaaggcaattgtcttcaaagaatgtggcaatctattctaacaaagtaaattccacaagggaacaaggggacagccactctaaattcactaatgacaaaaactttgatattttgtaattaagcacaatgcattattctataaataaaaatgatgtccttgtaaatctaaaagctatgaaacgttatattttctatttctaaaattctctaggctcaaagtcaatatgtaagtctaatttttttaaatgcacaaaaagctatgatatttcaaatcttagatactaaatttgtgaattgagtgaacctggcttctcccgcttagacgtgaacattcctgttagtacataaatattaacgaatattttaggccaaaattttgtgtttggtgattgacttatggaatcagtctaagtaggtgtgaaggtgactagacttattttggaacatgtacaatttcataacagtaacacggccgttaaataattctctttaaatgatatttaactctcattttaactgttagcccttgcattatgaagcagcttgatgctgaagtaaagctaagatttcagtaaaaagaataagagctttatattctagaaggtagaaatcctagaaaaatcaaagaaattaaaattttggaagtttttgattcatttcttatattttaaataggattctaaaataacatatctcttctatacataagaaaatagtctggttcacatattttgatttattgaaaagttattacagtacaactcaggttgccgaatactaacattgctataccagcgttgttttggtaaatgtttgcattataactctggttgtattacagcaaaacactcagaagaaagagagtaacttttacacatattacatagcatctgtacagtcatcccttaaaatgcaacaatacaactgcaacactttaaatactttaaaatacaaatgcctttgaagaacataacttatatactatttattaataggattaaatcaacatttttatggctctctaagcttatcccagaaactcttccattatttcagtgagtaacaagagaattttttttattgtttatttttttttagatatggtttcactctatcacctaggctggagtgcaatggtgtgatcttggtacactacagtctctacctcctggactcaagtaatcctcctgccccagccttctgagtagctgggaccacagatgcataccactacacctagctaatttttttttttttttttttttgagatacaggttctcactatgttgtcagactggtcttaaacttctgagctcaagcaatcctctccttggtctcccaagtactgtgattacaggcataagccactgcacctggccgagggtcttatagataggtaatattaacaccattttgcaaaattttaaaaataaggcaaggaaaggttaaaataagttgtacaagttcaacaagtagtaagtgaaattcagccagactttgaacatagacatcctgttttagaatctcaatgttctttctatttttcccaaagcaatctcactaactaatgtacgtattagattgcactgatatagtaaggacaaagaaaacccattttctgtgtatattgctattgccttagaaaatacaaatagctactgaaaagaccaatgctatgaagcagtttggtaatacctattaaaaattttaaatctctgctacactgtattaatattttatatcttaaaaagttaaagaataatagagcctaacttagatccttccaaatttgtaactcttcaaaatctaaaatgaatttctaattcatggcttataactgctcaagtaggaaacttatgacaaaaccagagacaagcccttccaacagtgcctatgacatcacagatatacaaatctgccccattttacagtacccaaagaagaccggaattcagctgttatcagacaataataaacttcttctggtaagttcgtctcttagtcttagatttacattcccactgtcagcaagaatttttaagttaaacatttttgaaaagtaaaaattcaataaatagcatttacattatccacagaatgtattttcattgctttggtgctaaaatattttattttaggctgttcttttttctcttttccatccacctcttagctcctttgctccaatccttgcacctttccacccttgttctctctctccctgaagcctcagggaagagggctgcaaactgtctggatgcctggaccctcacgctcctgagattaaacccagacccgcccatggcaagagtcccgttctttgtctgaagcaagtgtctgattgagttagatatggagtcgttatcacattgaaaagaaagcctggattttttttatctttggtattaaaatatgttatatttgtattaaaatattcatctaataaactctcccaaagaaaacagtttcattatattttcaccgtattttctcattccattcttaaagccacagtgaaaggaaagttgttgtggtcaccccaaaatactctttcccacttctaatcaaggtctggttaggacaaagctaaacaataatttctactttgtatttaaggacaccagctactgtttacccactgatgttatttatactaatagggggtctctgaagtgacacctaaagcttgctaaaggtttcaggagggcttttgtaaagtcaattttctcccagtatcgctttatccccacagagtaagcagatgggagagttctttttccctcaaaataaggcttatagcattgactagggaatttaaatgtatctttacaattctcaacttgatctcccaggaagagcttttatagatttggatttttttttgtcataaagtattctatttatttcccagcagctggtgtcaaaaaagttgtttttttaatattccttttaaataaataaaatctgttttcatattgtgtaaaattagttttgcctgctgtgagtttgtggcattatgaagtgatcatttcttcccatgaattatttaaagtgaggatatcaaaatctgatggaacaatacaatgaactatacaatacaatttaattttataatacgccagttcataatagtatctcaaaatgcacagtagttgcaatacattggttcagaattagcagatcaagtataagcccctcagtttcatattttagtatttgagaatcagttctaaattttctagtggactagagaatcatgcatatttggtagtccatagatacctaaagacctttttgctaattcctcatgccaggcactgatgtttgcccagcctagatgacattttttttctttttttgtaaatctttaagacattgagtttgacagctgttaaccctttcattacaaaacaatattggtattaatagcatttcccctggagttctctgatcactttgtcttagggaacaaatgcacctatgtagccacaattattcttactacttattctcactgcagagtttctagaagaagggaaacaacgatccattcaaatgccccactgcacttataagacttacagcaaagctgctaaaacttaaattttaaggtgagtgaggtggcataagggaaatgaatgagctgctaatgaatagggcaagacatgattagaagctataacaaagtctgactcaaggaaaggccaaaggttatcttgtatttgatatgtgtgttttaataaattataatcaaaatactacactgactttttcctcagtggattttctagcattctataagagatattttgtctgattaacttgctatattgaaaagtgggagtcagtatatattacttacaaattctcaaatagcctctgaaaaaattccaccacaaagattttaaaaaatggaagtatatggaaacaagatgctacaagatgttggaaatggttttccaaagcaagaactggcttaaaacatagaatagcaataatgagcacttttcttgttagttctacatactgtaaactaatttatgccccaaacagaactctggtttccctattatccatgttgccacttcctcctctaatctaactgtacttctctcgtctcagtgaaaggtgccaccatctgccctgacagttgatcaggccaaacatcagcaactctttttgcctcacccaccacatctaatccatcaataagccgcattaacccaaacacaaaagtacatcccaaacccgaccattcctcactatctctgctatcacgaacaaaaatcacaattatctcttatctggtctcctaactgatttctctgcttccactgttgcaccttataatccattatctaaacagaagctagaattcttgaaatgcaggaaagatgatatcattcctttggtaaaattctacaagttatatatagtgcaataagaagaaattaaaattcaaaaccatgaccagtaagtctctccattatctgttcatgaccatctttctgttctcatcttctaacatttttcctttgttcaccgtgcttctttgcctattctgtctctaaaacaagccaatcttattcctattagccctggtctagctatattgcctctgcccagactgctctgttcctacatctctgcatgactgatttcttcactcgtagctcaaatattatctccacagaaaggtctttccttgtgtggccaagatagccaaagcatccccaattcattctaccctgctttacttttctcttagaactaattactagtatcttccttatttacatcctgtatgtatgtgagtatgcacatgtacctgtatgttcataatctctattacagtataaattccatgaggatgaggttcttggatgtgttagttatctattacagcataacaacttacccccaaacttagtaacttaaaaaagcaaacaccattccacagtttctgtgggtcaggaatctgggctcagtataggtaggtgcctatgggtcaaagtttctcatgaggttgtgatcaaactgtcagctagagctgtggtttcatctgaattctcgactgaagaggaggagacttgccatgtgggggtcttcacatgtgaaggtcttcacacaggggtcttcacacagggctacttcatgacttggactttgctttttctcagggagagcaatccgggagagagtgatagagggactcaagagaaaaaccacaagctttttaaaaacttaaccttggaagtgacatcctatcacttctgtcctttattaaaaatgagtcactaagtccagccaatactaaaggagaggaaattagacaagcaggtgaaaatagaggatgtggagatcaggtggggccatcttagaagctgcctattataattgcttaccagtacattcttagtgttcagaaaaatttcggactttcagtaaacaaattaatttaaaaaatgactctctcatgaattagttccattggacattttgccaatgatcaagaaaaagtagtgaataaaatctcactcaagtagtgacattcaaaccaaaagagatcaccccagtaggaaggtttcattaggatgtgtaagcagaaagtagcagtacagcctcagtttcttcatctgtaaaatataaagagtagttgtaccatactgtcggagacctaatgaggcaattcgtgagggcctcatgaatcaaaggcagtggatagatgttagctattatctattcttaataagtataaatgcaagggaagcatttttagggaaaataacacaaatcatgtttttataatgatggtatttgatacatcaggtttaactcaaaaaagaatttaagaaccactttcaattgtttcctaattatattagcttaaatatgagactgtaaccaaaaagactaataaaattttggaactcatcaagtgtactgaaaataggctagaaagctttccatatatttatgtaaagttttgacatcttcgaatggacataatgatgcatttgcaatctccacaatcatgagggcctaaagggagagagatgtgtagagccctggaattgaagatccatggtgtgactggggggggaaagtctctgaaaagttaaaagaagacagggcactgaaccctgatctaatatgtaatggggttatgaaatttaggcagagggtagtcatagaattattcatgaaatcctagaatagtaatactagaggtcaaacttcatattcagaaaagtacaaatagggtcaggtaataaagcactattccatatttttttttaatgcctgccttggaaggtagcaaaacttaagtaagaagttggagaaattcatagaagatataccaaaatagactgtagtggatgtatggattggagtttgccatcagagaggcaaacaaggatgtctttaaacttatttactgatgtttccatttacaaccaaatggggtagatgcatcccacatttaaagaagccattccaaaagcaggaacagcacccctataagatgttatcattcctgttctattaattacagtgtcactcactcttttactgatagccctgatggagaatcagcatgaaccagccattttcctccctgtatatacattagcaaaactttgaccattaaatagttcaaagataggcttgcctcgctgtctcatgcctataatcccagcactttgggaggccaaagtgggcagattgtttgagctcaagagttcaagaccagctttggcaatgtgccaaaaccccatttcgacaaaaaatacaaaactgtgcttggtgtgttggtgtgcgcctatggtcccagctacttgggaggctgaagtgggaggatcacttgcgtgcaggaggtcaaggctgcagcaagctgagatcacaccactgcactccaccctgcagcctgggtgacagagtgagagcctgtctgaaagaaagaaagaaagaaagaaagaaagaaagaaagaaagaaagaaagaaagaaagaaagagagagagaaagaaagagaaagaaagggagagagaaagaaaggaaatctcagatatatctataatagaggaatctctcaaaacaatttctgcaatatccagtgtggtggatctaatggtgaccttccaaaagaaacgcccacattctaacccctgaaacctgagaatgtgaccttatttggaaaaaggatctgtgcagatgtaatgaggttaaggatttctagatgaggtaatcctggattgcccagggaagccgtaaatccaataacattttcttataagagaaaaaagagaagacagagagagcagaaggccatgtgaagacagaggcacaaactggagttacatagccacaagccaaggaacctctggagccaccagaagctggaaaagcaaggaatgattccccctcacttagagtcttctgagaaagtgtagccctgccaacaccttgatttcagacttctggcttccaattctgggaaagactaaatttaagctgttttaggccatcaagtttgtgctaatttctaatggcaaccctagtaaattaatacacccagaacaagtaattatgttttccagagaggtaatgcaatgtagtaaaaaaaaacattttgagtgagacagatttaggtttagacctggggtttctctatactaattgtgtgtctttgaacaagttactttatatctctatcttcaggttcttctttagtaaaatgatggtaagtttcccttgcagggtcgctgtgtgatatgttatttctgctcaattcagtactcaattaacctgttaatgataaattcacgcatgtgcaacatgtctacagacgttaaaaactgttgttttccttgaaaatcaacatacattttagcaaggtattaattagaacatatgggattgattaatgtggaaactagttgtacaataccaaatgttttaacaaacctttattacaacctgactattcatgtcatttcaaataactttcctggttgtcagtggaaccatattcagtctgttcttttactgtctcatctgtaatatcttccatagtttctaatagagaaataatgaaaaagccagagtattagtagaaaatgtttgcgtctagcttgagcttaagtcagatatagagtcaaaattgtgatcacagaattctcctaaatgttagtctcagaaaattgacaagggcataataatttctaggacagagtagtcaaattcatacccaccattgataccttcctatccctgacattaaaacagacaaaaaaaagtagttctcacaataattttatagaggaagaatataggaatcatgcagtttaggtatctcttattctggaataactccttaatactaaattgaggctctagtgagagctattcaaaatgcataaatgaaagtaaaataaattttcaagaaccgatctttcttacttttctagcaacaaacttttgaaaaaaattaaaaattttaaaaagtaaaatatgtaataaattagctataatatcatttgtagctattgtaatttattttttattcattcactcaacaagcattattaaatgcctagtaaatgtcaggcattgtgttaggcactaaagacgcagccttgaataagacatactactccctaccttaaggataatttaggcaaaacaatcaatgataataaagtgcacattacaggaatgcaatgtaaggcaattataattagggaatcggggaaggcattccatagaaaataagctttaaattgagacttgcaagattggttttatgtcagtggaggtgagcacatgggggaagaaaagagtaatgaagagtattcaaaacaaagagtagaacatatgcaaagaccagaaatgagagtgagcatggtgcaccgaaggcatgaaaacacgtttagtatgactagagcatagaatgctagggggaaaggggcatgaatcagtctagaaaatgagacaggagccaggctggaagattaatattaaggaagtcagaatactgttgcaataacttaggtgagataagatggtaccctggatgagagtagtagttctgatatgaagaagattgaacagattaaggacattcttaggaggaagatcaaaagtaccaggtgattgactgcatgtggaacagtacaggatatggaaaaggtaatgtcaagtttctaatgtcggcaattatgtagcaatactggaggtgagagcatgtttggggcaaagaggtgagtttagaacatgttgagtatgaggtgtctgtgagtcatccaagagaagaggtctagaaggcagtgctcagagagaagcctgagctggagaaatatgtggtggtcattcagatgcagatgctaatgaaacctatgggagaaaatgagattgcctgggaggactgcccaatgtgaggagagagcctaagagagagttcagagaacatcaactttagtactgcaaaggttaagtaagactagcaaggctgcctctaatgagactttatacaacccccttcatagtaagttctcactttctacagcaattcagggctcacacttctcttctctcttttgactctcaaacaaaattataagataagcagggtgggcaacaggacttcttgaagataaaaataatctaggtttcaagaggttaggcttgaggtcatggatctctttatttccagattagttttctttccatgccattactctactcccaaggattagctccttatagcttcttctttgttgttagcctggactgttgcctaggtgtcattttagaggggtgaagtttttttgcattatattatattaaaaattttctccatctggaactgatgaaaggacagaagggctaacctgaggcaaaactcgagagtggcagaactgtttcttagagcttccaacctccctcatctctaccttaccccttctttaaaaacttttgttcatttactcaataattagttattaagataatttgtggatatggaaattaacaagccacaccaagtctctaccttcacggagcttacacagtagtaaaatggcagacataagaaccaatgcactaaaagttaagaaagaggagtgtagaaccaggagacaccaagggcatacctaacctacactgaagaggttaaggaacacttcttagaataagtaatatttcaactaagatctaaaaaatggttgaagttgactgtcttggccactgttgcaaggaggaaaactgattcaaccaacgaatttagaaaattgtaatggaaacgtataggttagtgtgccatcctcttgtatttttcaaaaaagaaatcccagaatttgcaacatttgatccaaaaagaatgaatctcctcaaactgtggaattcctgcactagtactgatatggtttggctctgtgtccccaaccaaatcttaccttgaattgtaatcccagggacctggtggaaggtgattggagcaaggggggcgattttccccatgctcttctgtgatagtaagtgaggtctcataagatttgatgcttttaaagttatttggcagtctctctcttctctctctttttctgtccttctgccgccatgtaagacgtgccttgcttccccttcaccttctgccatgattataagtttcctgaggcctccccagctgtgcagaactgtgagtcaattaagcctcttttctttataaattgcccagtctcaggtagttctttatagcagtgtcaaaatagactaatacaagtactatccaagtataagagaaaacattactctcacctatctcaactcataccatgtaggcaggcccttaatctatctccccctgagtccagatttgaaggcaaggaaagaactataagtaccttgtcttatttatttttcaggactctaagttatattatctccattatacagtagagaaaaatcatctgaaaaattacgcaaatctgcccaagatttcaagccagtaaatggggagctaggtcttcattctggtcagttggctccaaagcatctatttattctaccttgaatatatatacacgtatacatatattttacagatggtgtttcactatgttgcccaggttggcctcaaattcctggcctcaagtgatcctcccacctcagcctcctaaagctctgggattacaggcataagcccccatggccagccaagcatatatatatatatttttttttgagacggagtctcactctgtcgcccaggctggagtgtagtggcacaatcttggctcactgcaacctctgcctcccaggttcaagtgattctcctgcctcagcctcctgagtatctgggactacaggtgcctgccatcacacccggctaatttttttttttttttgtattttgagtagagacaaggtttcaccgtgttagccaggctggtcttgaactcctaacctcaggtgatccaccccccttggcctcccaaagtgctgggattacaggcgtgagccaccgcacatggccatatttttataaagacttgtgcacagatgctcattgctactttatttgtattgctaaaaattgtaaacagtctaaatgcccatccttaagtgaatggataaacaaattatagtatgtctatacagtggaatactatgcagcgaaaaaaatggtgaattattgatacatgctatgacataaatggatctcaaagtcaatatactgagtgaaagaaggacaaaacaagtacagaagattctatttttataatagaattcaaatttttataaaattctaggaaatgtaagctactgtgtagtgatggaaaatagatctatggttgcataagaaaattactggagtaaatatatatatatatatatatatatatatatatatatatatattagctgagagtggtggtgcatacctacagtcccagctactgggaaggctgaggcaggaggatcacttgagcccaggagtttgaggttacagtgagctatgatcatgccactgcactccaggctggttgacagagcaagtccctgtctcaaaaaaaaaaaaaaaaaaaaaaaaaaaaaaaactttcatttctcttgtgtaaacatgtaggcatgaaatggctggataacatggtaaacatacatttaactttttaaaaactgtcagactgtctctaaagtggctgtaccattttactttactgccagcaacttatgaggcttccagtttctccatatcctcaaaaatcttgctatgctcagtcttttaaatgtcagtcattctaaaggatgtgtaatagtgtctcatgattttaatttgccttcttctaacaatgattgatattgagcatcatttcatgtgctcatcatataccatctttttctttttcttttttttttttttttggtgaagtgcctgatcaaatctttgcccatttaaataatatgttgtatattattgagttttcgaagttctttgtattttctggatataagttctttatcagatatattctttgcaaatattttcttacagtctgtggcttaccttttcattttcttaataatgttttcaaagtgcagaattttttaattttcatgaaatctaatttatcaacttattcttttatgggtcattcataaatgaattgtgcactaatcatctcctaacatactacatgagttacttatcttttcactgatggatcccaagtggctagtaaagtactgaatacacattaggtatcaataaacatctgatggataaattaaaatttcaaatagtgaaagcaaaattatagaaacttagttcattggcagcacagaaaataaaatagcctctagtgcaaagccatattcaattttttgttatctgatctagtatgaagtttgatcgatacaaggacccaaatttattaaatcttgttaaagaacctgatgctctctctctagagacaatcctttcttccccaaaatagaaatgtgaaattccatagaacttaaatgtaaagcagtaagtcccctacccacctctgtgcctcacctcgcccgtgactcaagtgctatatgaacccctgcaaataaatcaaggctgctgaattctcaaaagctctaattgtgccaattgtaaataagcctcaggatgaatttcaaccagcagtgtccccaaaaccattatctgcaactataatccattacttttctttcataattaatttttctaataggtcagtactatttgttttgtttaagcgctattccagcaatcccattttaccaacaaccaatgtcaattgtaattatatacatattttctattatatacaacaaatacattcttatattatgcgaaacactaaattgggcagtgattttttaatgagtaataaggtaatatgctacattggtgctcaactgcacttgtcttgaccatatgaattaagagtctagtggaaatttataagcaccttgaggacttccaggtatgtgggtgcttaaataggtactcaaaagatgctgcttattttcatagattttaatgtctaaatcactgggaacaatgacaattaccagagatatagataggtggttagataaacacacaagagatatgtatgttagagacatacacattatagagagtataatagggttgtatacacacctacatatacctatataatgtgtgtgtctgtgtgtttgtatgcatgtgtatgaaatcaaaatgcaattcactggaacactgaagacaaagcggtcaagcagctgagagaattcaccatactgatgagctttcctcctcagagagcttgctcctcaggccctcactcaaaggctctttattctttttagatacaattctaaagagtttgatatctacttttccatccacaacagactaaatgctgaaaactcgagagcataggtgagcttgtgtttgatgctagctgcaagcagcctgacacagggagaaatgagagctctcctagagccaatctggggagtgtcctggtgagggcactgagacctgctagttaggaggaggcctagtgcaaacaggcaaaattgcttggatgaagggtaatcaatctgagcctagttcttttggatgaaacctttgagaactcaatgacaagaggatatggatccaacaggagactagtagagaatacaaattcattattttgctatacaatgctagttgcattttaaacaattgtttctctatgaattttactaccaggcttttctgaaccattctgtgtgaattcaatactgcctggatttttaaaaccacttctgacactataaaccagagaaatctttcttaaaagataataagaagatggggccttgcatttctcataaaaggaaaatgactccaccataagtgtattcattacacactgttgaggcatgaattcagggaaaattagactgaatatgagattaccatcctaactttctgaaacactcccagcgctgtcaccagagttcttacttcaaatatttactcttgatctaaaaatatcttagtccaagaaacggaatgattactccacagttaaagtatatttagtgatctgagagaggagaagtttcatttcactcaagcaaatggttttagtaccacaaccaattaatagcttcatcatgtgtgagccatgattataaaggaatcggactaattttttaaacaaatctataggcttctcacaagggctatttttcacaatggtcaccttggaagaaagtcactccagggataccgtcattacttcagatttgggaccttacctttagaattggttcatgagaaaaaaaaaaaaagaaacactacatgcttcatagttaccctccccacctaacactacatatccctgatcaccaactttgaatatgcctcatttacactgatcaaccaaaagcctcctggaaatggtaacacggcctatttatcctgggctttactgggagggtgggggatgaagagggtttataggaattaagagagtctatttttaattatttcatctgtgaaacatatgaaattcctttggccaaaaatgcaatataaaactcagattatcaagggccttttcgtgggaccagtgaaatggagaaaaaagtctccatgacaaaatagaggacttttgggaatccttttttttctgaggtttgcatgtgtgtgtttctagcttggctctcacctgaactgctctttcataatctactgtagtcattgggtacctggaatctgggaaaactccaaccttactccagcacttgtgcaataacacagtaaggcacatggagtcaagtttaagcacttagtccagggttctttgcaccctgtgggccttcagtaagcacttgttgattgactgaatgcgtggctcactatcaatgtgaattaactatatacatactgcattaaaatccaacaacccaaatactttctagctttcaggaagtaatgcatctaattgacagaaccactcttatgcctcctaatccccacttcctacaaaccagctcaaaggaagagagagaatttgaagaaacaaaaatgaacataagaaaaacaattagctgatgcactctgcaaagcctgtaatattatctagaatgacagcatagccattgttcgtgctgccagagccccgcgtgtttgctagctcacccgaggtcctgagagaataataaactaagcagattagatgtagactgatgcctccatgccaccaccaactcacacaacacacacactgttctgagtgtctgaacacatgcgggcaggtaaacccagaaaatgggcactccatgttggcaggaggggaagaggctgccaacaaacagggcctgtttattatttaacagttggtactgctagaggcctggcaccgctatagagcactctctgtttcagtgcaagtcagcctgattatgagagcgtgtgagccaaatcatgtttaccatagtctgtgagaacctctgtgcccccaacagacatggaaattcttacaatagctctcgtccaaacagagaaaaatcactcctgagatggaggtaaagggccccacgtgcttaaattttgtctgatcagctggctcagtgtctctacatgtagttgttttttccctgctcaagacaagtcattcctctctaatgatacagtttctaatcctctgcctttggttactttactttgggacctaaatcaaccaaatactatgtcaatcacccatctactaatattgcttatgctgtcctgcacgctttggcttttcagcaaaagaatctgctgcccagggcggctacctcctgcttctccttcgccagggctgcctctgcagtaagtctcctctctgccaatgtgggccacaggtggatgccttcctacaaatccaatcagcaggataatgtgctactatcacaagagtggaccttaatgacaaagagccctgcttagatggtcaccccattaactttgatttgattattctgccccagcagaacacttggcttcacaaccacagatggcaacagtccaacataaaacctgtagacagagtagtcatgttgggttcatacattttcaaaatattaaatttcatgtaaaaatataaacatggtaagtattgagagagtccctggttccctaggaaagcactgttttcttttcttttttcttttttttaacaaaccaaggtcagagcactgagacaattgtgctaactaggcaacagggataatctaatcatttcttttgaaattcaacataaatcaacatttcttttaagtgtaagaacctggcttttatcttccatatacaaccaaggcaatctttgatactttatgtgactctattctatacaactgtttttaaattcaagataaaattggctctatataagctagttcaatattttgaaatttaattgtaacttggatacacttcctctgtgaccatgagtaaatcattaaaatgctttctaccaatgagaataaaggcatagcaaactataagtcttacctgaaactgtatgcagtgattgttttgtgttttgttttctaattgacagttgatatttatacactaaattatcaaactactatttgtttttaattaattcctcaactttgccactcaaggaaaatgatatatgctttgtattgttaagtaaatacataattttatacttatcatgttattatggttttcaaagaaagtagttgtccctaggtcacagattatatacacatgcatagcaaaaagactttacaaaaacaaggaaaatatgaaaaaataattgcctagcttggatcaagttaacccctggtttaatttaatcatctcctctactgaggatctgataagagattcttaataacagccccaaattaaggcaatagaatcaggaaatctttttttttttttttttttgagatggagtcttgctctgctgcccaggttggagtgcaatggcgcaatctcggctcactgcaacctccacctcctggattcaagctgttttcctgcctcagcctcctgagtagctgggactacaggtgcccgccaccacgcctggctaatttttgtatttttagtagagacgaggtttcaccatgttggccaggctggtgttgaattcctgacctcgagtgatccgcctgcctcagcctcccaaagtgctgggattacaggtgtgagccactgcgcccggccaaaatcaggaaatctttcccaaaacatcctgtatatagcaacactcataactactactttatggcagaataatggacccgattacaggttcacatggaaaaagttgatatttcagccacgaccaaaatataaacaggatttttcatagggagtagatggtgtgttcatagcgagataggtggtgtgttcatctctgtgctgagatacttcatcttaactagtaagaaacatagtaatccctcacattcattaagaggtatgctgtaagagcttaatatgtatacacccatttaaccttcataacaacctttattttttagtgactactatttacagtgattactattattttctccattttacagacgaggaaactaaagcacagagtggttaagtaacttacccaaggccctgcattatgtaaataaaggggctaaaatttgaactaaggtggtctggctccagagtcaaagtgtaatcactgtgttctgcttctcataataacgatcactctttctgaagcttgtgttcaatttaaaactgtatattccctgaggctgtagaatgttagagctgaagtaatttaaaatgatctaacccatggcctaaagctccaggtggagagaggatgtttgggaagactgtgtagcctcaaaattttgtggataggcacacttttctgggaaaagaaatgagccactcatctagtctaaatgtctcagttgagggattaaaaaaaataaagccacaaagcaatggctgtaaatgctgcatattttaaggaagcaatataaaaagaaccaagcccagaaaccagggctgttttcattatcctgtctacccaaactctcttaggtggctcccttaaagccagaagaaatctgtgtgagggatgccgagtcagcctgtttctctacttggctccacatgactcagtaaagcaaatcaatgagacaagatatctactcatgcaagaaaaaacagaaatctagtgtgatgttttcttgactattcaatgctaatggaaaaaagttggtaacacatttaagaggtaagaagaaataaaattgtctctttacaaagttgactgatttattcatttagtagatacacacacaggtatacacacatacacacaatttatttattttagtggtagcccagaaactttctgaatttcttttgtatttctcttgagtcttttcctgtaatttatatttacttaaaatttatcccttatgttcaaatttttcacatatatatataaagtattcattataatcattttaatttcctccatttctctggttatttccccattgtatttccaattttgtgcatttgtgggatttctcatttagtaattaaatcatgtgatattggtttgtttattgttctgttattctctttgaaaaaaccaactctttgatttattagtgtgtctcttttttattttctaattccttaacttctgactttatttttttaatcaattccttgtttctactttgcagatttgttttttgttcttttaaccaacttcatgagatgaatggtaatacgtttataattattttctttcctgtaatagtcatgtttaaagatatggatattcctccgaacactgttttatctatatctatacatacttattttctgtaaattctgtaatgcctcttaagcaaaaaattaattttaaaaagttattggtcttttttcttatcaattcgcaggagctcttattttttggagatactatttttgtctgagatacgagttgccaatcaaaatgatcactttttcatatcatgtaaaaactgttttttaaatttttatttgcttgatttttcttattcacaattgtggtaatatcagtagaagttcttctccttcctctcccagctttttgcttcctatatggtttttggtcccattagagttttattttcttcttctacttccttcttgttctctcacagacaattttatttctccttatttgtcttatcacttattcaatcctgtttatctagtttttgaactttcattttattttattttattttatttattttattttttgagacagagtcttgctctgttgccctagctggagtgcagtggtacaatctcggctcactgcaacctccacctcccagcttcaagtgattctcctgcctcagtctaccgagtggctgggattacaggcgcccaccaccatgcccggctaatttttgtatttttagtagagagggggtttcaccatgctggccaggctggtctcaaactcccgacctcagctgatccacccgccgcagcctcccaaactgctgagattacaggtgtgagccacaccgtacctggccttgaccttttattttaaggaggccacaatgtcttctatttatttgctagtatggaaaatagatattattttcttgtataattcttcttgtggtatatgttttgatctggtttctttgtattgcttttgtttttgtttaaagctattagctttgcttagctgatagctaaatctgggtccaatgcaggttcctttctgattagttttcatttttcactgagttaattctatcagctgtttgctgcaggaaagaggctggcacagtaaactgaggacttcagggagtttctttttggtaccatatttcctgttatgttttacctttctcaccaactcgaccgtgcacattgttcaagagatatggatctgcttagtgttctcagtgtcttgtcttccccatttagattagcgggagttccaaagggcttgcacaaagtcctgcctgatacattttccaagtcatgatctaatatttccttatttctcttctcctgaaggtgatcaacagtggcaaaggctggtgtggtttatcttctccaccttgccacccatgcatcctgcttttggcacatgtggcaggctggtgtcattcctcattcactgccacctcctctgttatcatctgttgtagaacaagccttagcaacccttctgcagaccacctatagcctcacactttcctgttgcatgtaagtaactggagcatgtgtccatcaacttttggatgttctacctgctgcctatatttaaaatactctcgacattgtccctgttctaaatttcgaaatatcccatggtttctgatttgagagtgtacctgccttctgtaagaaaaggcttttttatatgcatctcattttctatttaattgtttgttgcacagcaacatatgcgacagtgttgcatttagtttttcatctgtggcctcctaaatggcaaaaacaaaacttcacttattagctcctctccaatccttctctcaatcaagtgcttgcccgtccttgtccttaaacccctggactaatcccttgtaaggtgtcctgttgtaaggtgtcaactacagcattcacattcattgaccatttatatttcccctcataagcatatttgcatttaaataggagattttaaaaatctaaactaaactttagactaccagatgaagttataaattaaaactttgattgtagaatgacaaataacatggtatatgtggaaaagaagttagaggaccccaattagtatctgtaaaatgacctcatgtgagtagcaaagttatgtgtgagttgctttaatctttaaaattagcttctgcaatgcttcattgttttctataatagaagagtaataggaaaatgaggcatttgttgtaagtaaattttctagttacctgtttaagcagttttcttttaaactttaagatgaaaatctttacaatgagttcctattttctgaaacaaataagtgacttgatatggtagaaatgtactggagtgagtagttccagattcttaagttctttctgttacttattattaataaagttttgacacatcatttagcccacccaagcctcagttctcccatctgtaaaacaggaatagcaatacttcctttcttgcaatataagttttctgtgagtggaaaatgacataatatgtgtcaaaatactttgtatactaacaactagaaaatgataagagccttaataataaaagataatccaaataaaatattacactactatcaaagataatagaggctaacagggaagttatataaatactttcatgattcttttgtgtgttttttcctagttgtttagccaaggtactcacttctatttcagttctcattgccatcagtgagtctgcctctagaaaaaacactttctgttttcccgcctcctcttctccagtacatttgtatagtttttgtctttgtttctttggtatgttttctgtggctttaaattggctgcaaaagattgcatagggtaatgaaaagagaaagcagctttggagtcagacagacctggtttgaatcctgactgtgtttttgtgctcatcacttaacgtccctgaatctgtttccttatccataaaatgaatttaatcactgataccctgcagggctatctaatatgtgaagttcttggatttcatcaaatctcatttgccttcttaaaagtatattttgcttatttctgtgtttttaattgaagctttatgacatttgacaatggatacattgctgcactctgatcagtaattattttattcaatgaatcatttcactttttttctaaatgtcaccaaagactctagcttccttaaaatctactttttgttaatttccttgactaatcttatagttccaatagtttctctgcttcaatcagctttcttttgtctaaacttcttctgttttctcttgtaaaataatttatcctaatcttaaatctttacgacagagaccatatcttctttggccataatgcatcgaatattctgtaaaaaccacatcactatcaatcaataattatgtgtgtgttataagtatgtaaatgttatagatctcatagaacttatccactctgccttagcttattcctagaagatcacagattactattatatagcatttgtataactctttatcatttgtgaacctttcgtaattatttaatggaggtcttcaaactactagtatagattgattttgttatttctattgttgggaagggaaaacaaagacagaatgatgaaaacttgtcagatatatcccatgttaccaggaaaaacaggattagcacacagtctcttattctctgatctgctgatagtctgttgagctagtgttttcctagcatgaaaggaagaaacatctattcatttccaattattattttctggaaaaggtattatggagatggttctctttatgttcaaaataaataaaatgtccgagtgattcctggaacttgggagaaaggggaaggtaaaccaaaaactagggccagagagcaagaaggaggtaaaggagataaaattcgtggtgggtgaatcctcatccgtcattacatgacagaagtatttaaaaaggaaagctactacctctcctcatctgaggcttcctccagaaccctgtaggagaggaagatacactgctgagtcttcatttggggagcagcaggagaaggcagtgcctccttagccaaatgaacctttcctgacagctgtggggatatgtgtttgtgccaccaggccccttagaaaattatccctaaaataactaatgtttagtcagtcaaaacaacaacaacaacagaaaaatagcagcttcaaagcgaaagttatgtggcgagagtaaataacccaaacttaacgtgaccttcctagcattattttagggaggcgttagggtatagagagtgaaaaacaccctgaggtgggatttacaagtcttaatttcagtttcagcagtttcactttctggctgtgtggtattagacaagtggcttaacctctctggacctctctgatccttcagatttaaaatgagggggttgattactaagtgacgtctaagagcccttctagagataaaaaattccccaatctatgataataataattaacatttgatggtcctttaccacctacaaatgatttccacatacattatctaatttgatcttcatgccagttctgaggtagtattattatgattatgcccatttttggaagagagattcagaaaccacaaaatggcagagttggcattgaacagatgttcccaagaggcaaataccccttcagtaaaagaagcagctgatgctaacaaggataaataagagcagacaattcagcctgtgagctcttgtttaggggtacaacagaatttctggaagctgcattggggtaatgataatccaccatgtggaatgttatctgatgatgtatttatcaaaaaaaactaataaaaagaaaattaaaaaaagatacaataattgttactgcactacaccctaatgaattattgtgttcaaggttcttacaaaaaaaaagtaatattatactcggcttatgttttaattgatttattaatattttatcacaggaatgtaatttaagctcctcatgatttagatctcataaacctttagcattttgcaaattcaaattccaatttaaagccagggcgagcaattaacttttctatcatcttgtcaggggagaaggttcgtgtttaatttgagacaaagtgacagaaatatatatacactgtatgtattactccaatttaatttatgagtcagcaccatccaccttcaaaatgtagatttaatagaagaggaggaagaaaaggccgtgctgtcatgatagggctgtaatatctgccctgaatttcttacatattaaaaaaaagtcactggtttgttgagataccaagctagattgattgcaggcctatttccagttcttttgtttcacattccacttcctgattcttttctcatacagcacataatctcatggatatcacagggagttcttacccccacttctacctctactcctaccccatcctccattttcatgcatagctgcttctacaggtttatcctaaatcttgacaagtgagataaatggtaaatattgctttgagatcacgtcttcatcacctttctcatctttccaaagccaccttctaagtgctctctacctaaaacaaacaaacattaaaactcctcgcaattttatattttaatgtgcagggtgtatctggcacggtaaaacactggcactttcccgtgatcctttacaaaatatttaaggacaggatatgaataaataagctaaaaccacagaaggtagtcaggtgaactgtagggaagtacttccccttggtggttattaagcactggaacagggctgcggagagaggttaaggaattcttactagcgccgttatcctataattcaccaaaggcacacaatgctctatgctgatgagatgagttacatgacatctcctccctggttcaatcaaaggaaagcaatttacatctcaaaccagttctctcatcagtgggacataaaaactgcagaacagagatgcagcaaatgtgcttatttatacagaatcaactcagttgccactgttctttattattttccttctctcccacctcccctgtatggtggccattttgaataggatgcttaaaattctaaaagtgagaaaaagaaccaagaacaattcagtaacaaaattaactaaagataacttgtgcttctgacaatcagtgtcccttgtggtgctaggccaatccctttgttccacttaaaaataaaatcggattcctcttgctggccacaggaaaagaattagaagacgattaatggaaaattctggaaggtagccttgtaaatgtttattcacttttcaggcatacaatgttgtgctacataagtgaatacagtgcatttgtcaaagaaaggccatgttgaattagtgtgaggtcttcattcataaaacaagcttatttttactaataatctctattaatctcagcttaattatattaggcatttttcacttgcatacaacagtaaaaatggccaaaactgcatttactgcacctgcttaaacgcagttatatccctaaaaacgattgcagggaacaagctcccacagacatggcttttaggcagaatatgggattatggcagaggggtttaaatacaggaggtaaaaatggtaatcatattcatcaactacacaaagaagtaaaaacaagaagctctagataattctttttagtggactcactaaaataacaataacagcttgatgaagagaacatgattgtcgaaagcttgtccattttacattttctctttacatagtgcaataaaaaggaagcacctgcagtttctacttgtgcgtgtattcgtgtgtgtgtgtgtgtgtgtgtgtgtgatgttgaaagaaatcatggacatcatatttgctttaggagctactagtctaatcttaagtgcacattccctaccataaagttgtatttgagctccgtgcagtgcagaaacattcttcagcttagaaagtgcagtctttgcttcacacccttttccttcattcagacacatcagcatcttatcactttggacattaaagtaaaagagacttctttgtcatgaatatttttagacaaattacaccaaaatatcttgtattttccattttttagtggaatctactttactgacatataccagcccaccataacatcactgttgtgatgtcctactacttatctaaaaaaagtactattaactacatattgcaggtatttgaagtatataagaaaaccataaactgaattacattgtatggctggtatgatctcacatgaagtttgagctatcattattaaaaacagaaattgcatttagttaatgcatctgacagtaagccagtcaactttcaaggttgtatgatgagaaaaaaaatattttttaaaaaaacagaaaatgcctgaaaaatttcacaagagcatttcacatgacaagagaattcttcctctcccttctgctgcctgcctgcccacctttcttccttccttccttcgttccttcctttcctccttccttccttctttccttcctttcttctttcttttcctccttccttccattcttccttccttcctttcttccttccttctttccttccttccttcttgccttccttcctttcttctttcctttttcctctctccctctcttctccttcctttcttccttccttccttccttcttccttttcttttctcgtgcttctctcccttagtttctctcttctttccttccttccttcaatttggtggaggaggtgcaaaaatttgagtaagaaaataatatttttgtttcagaatccacatgcttttactattcatcatgctaacttagggggaaatttagataacttcttatggcgttttttttttttttttttgagtttatagatatctttcaggggtcaagctatttccaaacattcttataatggcctccaatattccacactgcaatatatagcatgctctaagcaaaggcagtcttttataaaagactgcaatagctagtgaagaaatacttttttttgattacttttataaaggcacagagcaaacgacagtacagtatgtacataaataaagcaaaggttcaaactgcacttttacaactacaatgtcactaatagacctcatcccctctctgctattctatatatataggttgaaatctgaggcttaaaacaatgtttgaacaacaaaacagaataaatgactaacccaatctttcaggttccaaaaacagtactggagagttttctatttttataggtgtttgtcactatggacattcaatatctataattctgaaattacagccgggcgcggtggctcacacctgtaatcctagcactttgggaggccaagatgggtggatcacgacgtcaggagatcaagaccatcctggccaacagggtgaaaccccatctctactaaaatacaaaaaattagccgggcttgttggcgtgtgactgtagtcccagctactcgggaggctgaggcaggggaatcgcttgaaaccgggaggtggaggttgcagtgagccgagatcgtgccactgcactccagcctgacaacagagcaagactccgtctcaaaaaaaaaaaaaattctgaaattacaacaaaattaggatctgaatatgtgttttacaaaatgatttgctataggccttcatgggggagatggcaatccctagtatatcaaacactgtggcttaattttttttaatcttcacaaaactcttcaagaatggttgtcataatgtaagaagtgtcagcattaccagaacaatcagagatttccataggcagaataacattagagattacgtcattacaacagatagccctcatactcaatgcatcttacatggtcagttaaaccaaagggtaggaggcactataggataattgtgagaagagttgctttctaagtggaagaaaggtgaaaataaagcacctgcagtgctgtgctttcactttacttcctgccctcacagtcatcctggagatcttactggtgtgctttaactgtcttgtggcattctctttcaaaagcatcttcagggactaaagttcaggttttatcagaatagacatagtcctgtgctacttgacagaaggcattttactcttttttatggtttcactaaaatcaagagtatcacaaaaacatcttaagatctgaaactgggaatcgcctcataagcatgtcttccaaccctacaggttgtataaggcaagtatgtgtagattgaatggaaccctctatgtctggcttttcagtattgtaaagactttcaaagctcattaagtacttctttgctgatacacaccaagctaagtcccacctcagggcctttagaccttttgttacccatgactggaatgctcttcctctagggtttagcatgcttctctctttattctggtttctcctcaaatgtcacctcttcaggagacttacactgaccatcacatctgaaatagcttgccaactttactctacctatctcactttattatttttcatagtatttatttttttccggaaattatgtactgcttattatctgtctcccctaataaaatttaacttctttgaaccaaatactttgtcttattccttagtttattgctagtgtccagtactgtgcctaatatatggtaggtgctcactatatatttgtcaaataaataatacttaaaatttaaaaatttattctcctttaagttgtacagtttaagcctcaccttattttctgctgataagagaaggtatcacctacaatgacccttcacattctagacaattaacaaagtctatgtggaagaataactattccaggaagaatgtgttcagacctggtttgaaatcacagcctgttgctgtggggcatttattacccaccatttagctagattactgaatagatggagttaaccaaaatgctgacaagacacacaccacacacacacacacacacacaaacacacacacacacacaccccccaaaaacgaaacctcagccctccaaaactctccttactcttgtaattggagtgcattgccactttgctccaagccaaagaacagataagaaagagaagcaaaaatcagaagaactttggaagccatttcactagagctgccacctgtcacttacgtaagaagatgcaatcatccatctgtccaaactggtgaatcataaggtcttaaatactatttactttccccaaaatagtgaatcccttgcaattttatatcacataataacaaagggacatgattcttatttgtttttcctttagatacacatagaacattttctttaatgtggcatacaactttaaaaatataaacaccaattcactgaggtatttttttggtagaaaaaagtgtctatcataattttagtagcaataatagttctgtacatttcttttagcaattacaacctcagatttctaagcactgtgcaaacattaatttactaagttctgctgtgttctctttgtgaattagaatattatcatatcttcattatttttaggtgagagtcacatggctatgacttgccagggccacacggtaaataattttttttaaagtggtaagatgcctctgttttgaaagtggatgcccagggaagattaataaaataggataagaacatacctaaaatggcatctgtttttttttttttaacctagtgcttccattcaaattttgttttgggatatgaagtcacctgatagctcagttcaaaactcgaataaacatccttgaaaatagtagggttattctttaaaaatagtagttatcaattattgagtgtgcaccttgtgccaggcacagttctaagagatctagttctaggagggaaagtgtacgagtccatgtgaacaaggacttggtgtcttattcactattgtatgctccgagcctataacatacctggatggtagtgagggttcagttggtatttgttgcaataagtgtataaataagggaagctttcttggttccagaaaactaaactgtctgaattttgaaacacaacctgtttgtaagttgggggcatcatattaaacattttcttttggaagcagaggagaagggaagagattttatttgacccaatatataaccaaatctaggataatagtgatcctctttacaataaagttcatttattcaacaattatttattgaatacatactatgtgccaggtattggaagaggttctaggaataaagacaaggtccttatttcagaacttaaattactgtttatgggcataagaggaaaatatcttcatatacaatgcaattatgaggcaagatttttctatgaaccagtgacttctgtttgtttttaccatgttaccctcctaatttactaaggcttcaattacttggttttcttctgagtagccaggaggacattatagcaaaaagtaagtatactgattaattacaacatatatccataaagtggaggggatatctgaaaatcacctagagaatctgaccaatatctaagaaattaatttaggtcaaatgattagttctgaaatgtctgagttatctatattagttattcatattgccagttcttaacttgttctatacaaacacaatctgaagcttcatctgggcttcttcaaattggaacctagttacaactcttaatggataagttcaagaataatgccactacaataaaaaagaaataaagaagggcacaaagtattagaagataaattatctagagattaataaagtctttggtaagagtttgcaactctatcacatatgggctaattggaaatcactgcttccagggctaatgacctcatttgaggttaccctgtgggacaataacatggcctacctctgtccactaaacaaattctgtcaaaacataacttaccaaagtatagcttgttgaggggtatacatatctgaatttattttactctgataatctgcccgagaggttctgttacttgaaggcaatatcacttcctttgggttcacttgtaggacacaaaatgcagcttttacaagtatttctgcttgtaaactaattcttcagctatagtatataaacttcactctataagaaaaccaaagaggccaagggacattaagtttggtgtttaattgctatcagcaattaaaaattgctagcagcccacttaacattttcttcttcctctaaaaatgaaactgaaacgtatcttttagctgagagttctgtaatgctgagaaaacatcctaaatacatcttggcaaaggaagaaaagaaaaaaatgtgatattgatgtatttgctttcctagtatattgaaatcaagaactagatacaggtgacagatctgcttccacctgctggctcagtgaatttgtaaaactgaaatctgttatctaaaaatcactagtacattcagaattacttagcattccctttctgtttgtacatgttcatgacaatgataaaacagccccaggaattctgctaccaatcttcatatatatgtccattgacattgtctccatcaaattcaatccaataaaattaaatggagttaaataaagcagtctgcttgaacctcagtatctctcatttcttattgtattgtacctcttatcatttcttatttatttagccaaggttaaaaaaaatggtttccagattcaattataatttccctcctggtctcctatttcttaagtattttttcctttttattttcatataattacaaggatttttttttttggcaattgacatgaacaacattattcaaaggaaaaaatacttaaagtagctactatcttatagcaaagaggacatttccatctatgtttaccataaaaattttcactggattccaacattttcatataatactatctacaaatattgcctgctttgagaagactccaaattttaggaggtagatgggcgataggtaatgcatggaggaagttggtaaagaagacaaatttctaactatgacttccggagttaaattttaaaagaaattgagaagtatacaaaagtgttaagactgaaatatatgcaattggcttacaatttctccaaccacttgaggcaagagggtaactccaacttttgccccttcattgccacacttcttcaatctgcatatggattttatgtttcccctttacggctgcccttaatattaattttaacctcaaataaaatttttttggaaggaagagtaatatacacattataattttctctggagttttcctcccataagcaacagccagatgacaaccaacttctcattagtctcttgaaaaacgaatcagaaattttcttatgtccttcacacaggattgccatctattataaatagtgctgaaagaccccacacacagcaaactgaagcatgtggcatttaatacatcacacagaaggatcaagaattgagtcaacacttctagggcttctacccctcaactatgcatttccatggtacccatttccatggtttttagacttttaaacaaacacatttgtctaaaaacaaatacatatgtaggaaacatttctccagggctctcgccttttcagctgcttttggttgacagatgagaacccacatacagtattctgaaattctgcgtcttcttgtcttaagtactagagaaagaaatatttggtcctaggtggcagatcttacttatatcacttctattaaacgggcaagatagagtcacaaaaagaggacttatgattttcaccttataatggattccttcttggcttccttccacctcctatacatggatttgaacttcattttgaagacacttacaattattctgaatgaaaactatcattttcattctccctctcaaaaaagtttctgaagaaatttgttgcaaagccatgctatctgtaacattacgaatatgttagcatatttttagtgcttcactagatttcataaatcttacttacccatatcaataacaaccagtataatttgaaggaaaaaggagaaatcttgtgtcttaaattatatcatttaaaattcatggatgaaggtagtatccctagaaatgatctgattctatgtgactccgggaaagatactatttcatttctgttttagagattaagaaactaaagtacagataagttaactaacttgcctaaagccttctggtgaatgagatagccaagatttgaaccgtggagtccaacgccagaggcttaaccattacattattctacttctgtgttaagattaatagagaggaattaaatgcataattttggaggcaaacagcttaagttcaaatcccaatttcaccagttactagctacatgaccttgggcaaagatcttaaccactatgaaactttatttcctcatgtatttaaataatagctgttcttcactgagtactaagctatgttccagttatcgatgctaagtgttttacatgcattattccatttaattatcataataactcaaccaagtatgtagtgttatcatcccagatttagagatgaagaaactaaggttgagtaatttgcctattgttatacagtaaggggcgaagacagaattctagtaagggcaatctcactctagacaccttactcttagtcattaaatttggtgataataaccaatagtgtctacttcatggggtttggggttgtgttttggtcaggattaaattaggtaatggaggtgtaatggctaattttataggtcaacttgactgagccacagggtgctcagacatttggtcaaacattatttggtgtacttcagtgagaatgtttctggatgagattaacatttgaatcagtaactgagtaaagcagattggcctccctcatctccaaacagttggaggctggaacagaacaaaaaggctgactctctcacaggtaatagggaatttctcctgcttgacagcctttgagctggaacattcctttttttttcctgtcttcagactcaaactggaaacatcagctctctgcaggtctctggcctaaggaagttcagactaggactataccattagctttcccaggtctcaagcctttggactaatacgttggactaacgcaattggctctctggggtctctagctttctgactatagatcttgggacttgtgagcttccacagtcatgtgagtcaattccttataaaacatctcttctatacaggtatacattttattagttccaattctctggaaacatagtacatagtttctgacacccagaaatagttaatgaatgtttcttaaactgctttcccaagaaaagccaacagaaaaggaattataggatgaaaaagcccccttcagtaagagcaaagataggtccagatgaggaggataatgttctgtgggcactcggctcttaagagaggagcaggggtaggggcaaattttaaaacacgatctgcagctaggtcagatgataagcttgtttatgaaataagagatggcaggaaaaccaggttgatccagatatcaagaagaaaagccactttcatcttccactaccctaactggaagggaatcttggttccttaccatgatagcaagctgactagaaatatagatgtgatctttccctttgaaaagtaacaggttacagggaaagtgaaggaatttatagaaaaggtcaagtttgtttagtgccttactgtgtactacttcaaccaattcagctctatcacccaggttggagtgcactggcacaatctcgtctcattgcaacctccacctcccagattccagcgattctcatgactcagcctcctgagtagccagggttacagacgcaccccaccacgcccggctaacttggtattttcagtagagatgggatctcaccatgttggccaggctggtctcaaactcctggcctcaagtgatccacctgcctccacctctcaaagtgctgagattacaggagtgagccaccgcacctgccccaatccaactcttacatacatactttgtttccagctataaaccataggggcataaaaagacttctctatggaacaggttaggtccctgaagttttcaggtctaaacatgctggagatggcaattaaagctttctaatatatgcgagttacattaatatctttgaaatacccattcaattaccccagctcaacacctgttagacaccctctctgtcaaatctcttctgaataactttgtttagttagatttggggccagtatcgtaacttcacgtagtctgtacaggaagaaaataagtaagctttactctggatctcagggaacatgtgtttctcccatcatctaagctaaaaaacaaggaagctgcaacagctgggacaagaaggaaaagccaatttgatttttaaagaaaatagaaaataaaagcaatttgtccaattccaatgtgtggtatctatgctgatttttctcaaggaaaagtgcttatcattgccaaaatccccaaagtaaccacagctgacaaacttctcagcatcagagcacttggcaactgacaataagacctgctccttccccaagcggataaaaagccaggaactccccaaacaaaaccaacagcttttctgtactcttagtctgccttcatgtcttttgagcacagtatattgtcctgtgtaactggaggttcatgtagcacactgattttacccaaagcatcaaaactaatataattaatttatataatcttctagttacactgactatagaacttaccttcactacctacccaaatgtctgctgctgatatatacatatgattgcacaaattctaaagagtactctcaataaacagaaatgtaagtctgctaaaaatgcttaaatatacaaagaaatgcaaatataagctctctaccatacataggatctttgtttataccagttgcacatgatcaatggaaaaggacattcaaaacacttttgaataaacaaattattatcttgcattagcttgtatcaatagaatccttccaagtattttttgttcataataaaaatgtgtataggttggtttgattattttttactcttatcatggcaactcaatataacaatactgtgcaggtggaagagggaagaggggaaaggagagaagctgcaaataaccaatttaattaccctaacagtcatttttttttgcaggaaaaaggttccatatgataagaatgtttgttctgatcaaatatctttgctccataaagaccttatgaatcttccttcaatgtgaagctaagctatttctgaggagctactggaacctcctcattttttctagaggtatccatgttctaaaaatctcaaatgatctcaacttaggaggttactgaagctacataaatgtcaaaagaaatgatagatttacacttctccaatttctgcatttgttatgtagcataaattcatgacagaaaaaaaatgatcctcaaaactccttagaagctcgctcaaaatcttgttttaagtctactcaaaccaaaccaagttctgctaatgtaaacccttaagatttgtggtagtttttcattcccaatattaaaatagtcttttattaattctccatcacatcatattttcccttgactactaaatcaggtccacatttgttgcttctatgtttttgacatcatggaagaatctggagcagtggtacattttgctcttcagagatattttattggtttaaaatgtttgattactaaggggtttaatctagtaatactagattaagtactgtctaccataggaaaaaattcatcagacttaaggtgtttcctcttaagtggaagtagaaagccaaatttcaaagcctaccgtgttaataacaaatgcttccttttatattttcatcaaaaaacaagcctatttccttatctaagttctgtgcaagtctttctgattttctcacaataaactatatgtgtgaaatcccatcagtgttatcaccaatatttattcctgatggccacagcttttctaatctttgtgtagccatatgcttaatgttacataacccacttggaattcctttcttacaaacaaatagcaaaaatgtaagtttatgaagtatgcattccttttttaatgccaaaaataaaaacaaaggaaaatttctaaattggacatgtgataatacataaaatctatctgataaaaagtgtgtaattactgtcacaaaatcttcacacaatccttgaaatctcagcagtagggtggcaccaagttcccacacatcaattaaagcatgtacatatacgtcattggcaataggtcagtctcacagagaataatctcatgatgccaaagctatcctacctgaactttaattcctgaataacaatgttggctaatagtgttttactggatattgtcttacttgctaacatttcttatggggatcttgattaattggctacctaatccccaaagattattccagaaaataataatgtctgaaaagtagaggtcttttctttcacctatgcacaaatttgtcatagttaatatgaaattactttgttcatctgacccctatcaagtaaaaacacatgaattaagatcagcatgtaggtgaaatgcacaagaaattagggccatcttgagaggactgtcatctagtatgaatcacatactggttgaccattctccctccaatcccatatttttatggggttatacttaatacgaagaacaagtgattaatggagcattaatcacagaagtctactgactaaaaaggactgaaaattctgagccttgcttcagtggtgatggtggtgggaatgtgggaacaaagttgctgcacaggtaatccctagttttgatccaaagaaatagcagccaagcagaaacagacagacagacacacgcacacacccctcaatatatattaaaaagtcaaatttcattcagtttctcaagaaaataccaagaagaataagacagaaaatctctgttcttagtcttggccactttattctccacatggacaaccactttgcatcaaaagtctctctctacccttactttcacctctaagtcttttctccatcccttctatcccttatgggtacttttctttcctccctcctcatttttcctgtctctagccccttccttttacccaagtgaaattttgtcacttttgagttcccctcccctatgatcacttttccagttctatttttcattcccccaattccacactacccaagttttgacacctagctggcatgaagagagttcttagaagaaatggaagagaatgagaagaagaagtcttttctgtgatacaagaaaggagaaggccatgactactgacatgaaattaaccttgtcccaaccacatacacgtacacctcaaagctttgtaaaccactggcaaataccctcttattatctcccctgccccatctcccctttcttttaattttttggttagttaccaatcacaggagttaacttcctacatagagggtagacaaatcagggcaatctatgatctctttaggtccatggatagatgttcacccccaaatgcagagctctgctaaatacatctttcagtatctctgccttcttagatactctaagctataactctactttagttttagggtcctttttgcctttttctggccagaacatattgcttttatatgtcttccttttcatcttcccaaatgccctaataccagcttaggctaaatgtgctactggtataaaatgtatctttctccttaaaaaacaccaattattctcaacctctgggatccaaagcatccggaataggggccctcttcaataataatcagtgagtgagtgatcttaaaagatatgtggtttaggaagatgaagttaagtatttaaggtcacaaatcaagtgtggagtggggctgcaacccagatccagatgttctttctgacatgatctctcattgtcttttttcttgtattaatcagttgctaagtcttattatttcttcttcataaaaaagctaatgatcatcttattgcaacaccacactctctataccacaactatatatacttattttggaaagctaagattattcaagtaagactaaacaacacataggaccttcaaaatatgctcctaatcttcccttcttgtcttcgtttctgtctcctggtcccagttcctcccaactttatgtatgcatgagtcttttcatgatcttctctctgcctagagtttactttcacttcccgccaggaaaaaaagaataagtaccctttttaaataagcaaactcaaatattatttgctccataaagccttcccaatatctattccatgagcctttcccaacatctccactttcctactaacagatcatatatcctgttgctttaaaattcctactgctttcaaattctttcttcttgctagattgtgacatgcttactggcagaatccatgctagatactgggaacacaaggattaaaaccacaacccttgtactcaagaggtttccagtacactagtaagtcaaaaatataaacaactacggcacaggtctgatgtagaaaacatatttctatttaattgacttgaattatagttgcacacattttgtgttgtaaccaagattatgttacatatgataatttaagtagccaaaagttgactcaggttgagtagagaagtaaaagcacataagaaagagaacaggaagaaataaaactgtaaagatgtaatgggagagaaaatactgagttaactgaagtaatggcttaatgcagaaataagacgtttggggaaaggaagttgaattagttgaagacatttttggtaacaagagtcatgaagcctacagttgccagaaataaaaaaaaaaaaggactgactatggagtatttattaaatactcatactcactgtttgaagtacaaactaagaggaatcagaggatcaaagtggttggttatgacttgctcagctagtaactgcaagtgccaaaattcaaactgtggaatatttcaaagtccgccctttctaaattcaattttggcctaaatccaaggaggtagtgtccacagaattagctagaaattacttatttcctaaaagatcaaagtcccaaagaactctgtatgatttcaaggctgctcatatggtaataatggatacatttcacttcatagtctaatcaactaatagactttaggacagtgaatatgaatgacatgaaggtgccttgagaaccatcaagtcctacctcttattttgagactaattgaagatactgaggcccagtaattgaatcatatagattgctaaaagaagttctgagaagaaatgaaatacaaaagcttggtttctaaggctgaatatcatgagaaactatcatgttatcctgtgtgagtgagctccacgaggccaggtatcttgtctcttttatggtcaactgtatctccagtatctaggagagtttatggtactataactagcacatagtgagcacttaaaaaaaatcaggtgctcaaataacacggtttagtgaaggaattaacgggttcatatatgtgaatgtgtgtaaagtgggtgcaagcatgtaattaaatggaaaactggtcatatttagttagatgttactaaatttatttttatttgccatttggatcacatgattttctcctttaaacatcccagtgacattataaatgtcttatgtagcaaggtctttggcttcaaatgccttcaccaggaattaagagtttagtacaccatcaatgaatagaatttacaaagtaccctttgggcagaatcattaaggaattaaggaaagttttttaacatattgagaaataacacaaaaggttctgaaaataaaggataatatgaatatttcatctttgtcttagttttggggggtggggaacacagaagcaatatttcatttctaaaaccatgttcccatgaagctgagcagaaggactgcttataacataattttccagccaaattcccaaagggcccccaacaggctttctcaatttgtgggcgctgtcctctaacaatctatttctttccagactctccttggaaaccaaagatttatgtcattctcttcatattttaaaatgaaattgttccaggttaaagaaattatgaaaactgaaagcctgtctttatccaagaaccaacactgcctggacaaataacttatgaatacatcctattctggaggtatcatcaatgactttgcctctgtagcactcttaccattatttggacatttccagaaatcaagatccacttcagtttgtgaagatgagctgtgcttagacataggcttaaaaagaaaaggtaaataaatattctgtcaggttatatagagggaagcagaccctcccttttataaataacgtatacatttgcttaaactccagagtaaaggaaaaatctcatggactgaaaacattttttaaaaaaatgaatattcactaaacaatcctgaaatgctttttgctctctgaatacattcaaacaagtagatatcacagcatttcattgatagcttatcaaaccacagaatagaacaggaggacagaatacaaagggcattcttaagggagcaccatcatgattgttctgtaaaaacatatgaacatattgctataaactcatcttcacaggaagtcacacagcttaataagcacagacctgcaagttaatattaaaattcactttgatttcagcagcagcaaagctgatccaactaggagctattacataaaacccttattgtcatattcgtcatcaccactctcaatagagaccactgccagcaccaagaagccagccctcagttcacctcaggaaacaggctacacagacggccgtcccagtaacaatgcagcagtgagatggccctgtttattttatcagaatggcactcccttaatttttcagttctctttattgatgtcctttttcatgtacaggtctattagattctacttcctttactgtcctcccaggaattggtgcttgccaactacaataagttgttttgacaacttgtctagctatacaatactctgtttccttccctctacagtctttttggcttcaaatgagtgccttcaaaatatagcagagactatccaaccaaactatgctacaggggggaggagctttctatgtgtaagcaatgtcctgcccaaactacaatctttcatgtgctcatagtcctctttcttttcctatttatttttatggataaatcccccttgctatcttgtctactcctatcttaataaggaatgactgccgtgactacccccatctagctatgccattcaccgccagcacctctgctctcctcgtgtgcttcaagaagaactgattagcactttgcataattaacctgattagcactgtgcataatcaaactgattagcactttgcataattaaaaagaaataataataataacaataataagcactaagtaatatcaaaagctgttagtcccacagccctttggttacctccaagattagttcagtgcagcatattttgcaccttcacattgaaatcttttctttaactcaaaagtcaagaaaataaattaaaatgcttgcaatccacagactcgttatggttttcatatccataccagttaccaaaataatcagtttcttacccatacacatctccctcagtttgggtcttacatattttacccatgttaaaatggagaaaatggggatataaaaccaagtgaatgaaaaatatttagaataacattagaaaacaagatatatgatgcgtatagaagcatagagagagttatatagaactatataaccctcccttgtgttgcttctgggtgacaatgaggcatgtggaaagaactggacaacctatcagaaaaacctggctatgacatttcctggctaagtgatttaactttttggaacctcagttccctcatctgcaaaattaaaataataacaccagttctgctacctcaataactgtaattaaaataataatttaggaaggtgctttgtgaactgcaagacactttacgtacatgaggtattccattctaggtccctaaatctcctatcccccaaattttatttcacaccatggacaatattatacattatgaataataaattttaggctcagtgcagtggctcacacctgtaaccccagcactttgggaggccaaggcaggaagatcacttgaggccaggagttcaagaccagcctgggcaaaacagcaagatccccatctctacaaaattttttttaaaattagcggggtatggtggcatgcacctgtagtttgttttttttttttttaattttttattctcataggttattggggaacaggtggtgtttggttacatgagtaagttctttagtggtgatttgtgagattttggtgcactcatcacttgagcagtatacactgcacacaatttgtagtcttttatccctcacaccctttccccctggtccctaaagtccattgtgtcattcttatgcctttgcatcctcatactcagcaggctgaggcagaaggatcgcttgagcccaacagttcaaggctgcagtaagctaagaaggtgccactacactcctgtctgggcaacagagcaagaccccatctctaaaaaaataagataaaataaaaatttatatttataatgccttaaaattaaaaagttataaagtcctgttgcatgctttgccttatttcttattcagggctgaatgtgactaaaattttgacttggagttaaaactggactctagtaattattgtttccatcacagctctcatttgtgtttctgtggaggttaaaatcaagctgttgctggaaattcacaagagaggagaagaaaatctagtacattactattaatttgggactacaacataagagaattctgcaactctgcttttctccaccctaccatagccaaccatctgttccttaccaacttcgaggcttagttcagttccactttcctccaagaaaccacctatgatacccatagattggaaattctctctttctctctaatgcttccataatattttatctcatgcttccatagtacagtgtactatttattaaatatgtgtatatctatctgatacctttagtagattagctgctcctaaacagaactatgctgcctattcatttttgccccagaaatagctgccacaataaataatgtagtggtgaacactcaacacctttgttacagttggcttaaggaaactggatggtaaactatttttttcactaggcatttactatataattgctaaatgcaagcctgagaaattgtttcaataactatatgctagagaatacaaaggtgtttgacatacccataactacttaatcaaccattaaaaccaaccattcatttattaaaaaatagatagaagtgctagtaaatactaggcattgtgctaaacactgaatacagcattgataaagtttaaaaggaactgttggttcctctcaaggagcttatagtctaggtctctattaagaagttcatattagagaggctggagtggagtagtgtggaaaggaaaccttaaaatagcaagatacacatcatggagccactaagcctctatcaacctacgggaaaggaacccaaataagcagtcagtgttcttgggcaaatcattcattttacaattcatttaattcaagaaggaaaatgctgctgtggagattattcaagtccaaatgttcctggtgaaggtgcttccagtaattctgggaaagaagccaatcccttagttttatatgtaaatatttttaaaacacacacatatatataagcacaaaagaaaggtcaggaagacgtaagtcttttaaaaatctattttaataattttttctataactgtccacaaaagtttgggctttttttgtagccttacattttcttttacacaatacacctgcttttttttctaaactaaatatttcttccatctaatgactctctttattagacagcatctaatttgcatacatttacatacaatttaactgctagcttgtgagaacaaagaaatggctctgtattgtactgaaggacaatactcagtaaaggaaggtataaaaaccaaccagcttggtgactgtgtaagctctttgtttcagatataccaggctccctctttctcttttaacataccatttaaaaggggcaaaaattatttcatcaaacaatgaaaaaaagaaacagccctactttgtttaactgtccatttcctctccagtttggttactacaattcaggggtccaagttccctgaatctactacaatttcctctattatatttgatagatttaatccctttatctatttttgtttcgtgtctcattcctaaaacaacctgggattccactgcgataaagctctgttctgatgctaatttgtgctgccatcggccttgttcccaagcagacagggtagaatatggcatcatgctctccagtgaacaatgcatacacttacccttaacaggttaatagattttattgagactttgggtctttatcatatgaaccagctcttcaaaaagaaatggttttcagcatctactggagagatgatggaaaagaagacttgaatatagggagggaaatggtaaaatagatgttaggggtaaaagagtacttgagtcaaatgtttctccactcagcaatgctatccctttgtaagtctccaaacctgcatgactcttggagaattaaaaaaaaaaaaaaaaaaaagaactgaaaaccagggacccttgactctcctttgaaagtaaattcacatactctgtgatacggggtgagtcactatgactcttctctctgtagctctcatccttgacacatggaaaaggagattatgtaaagcaatcttgaagaggtttgttcagtgttttgtaaatattaacaattattgaaaacacacaaaataactaataaagctgcggtcacaaccaactgaaaataaacactaggctcattcaagtttctgaaatgccatgtctaaaataacacacaaaaaagaaatatggtacacaaaaatgcttcaagattataacaagctatacaaatgtaaagcaggacataagggcaaactgaaaattataaagccaggtacgaattggcaccaaagcctcgatggaattatcatccgtatctgggtgctgcaaatggtcatgggagatgcatttccttggacatatatttaacattattaatttggcctgttttctgcatctgataatgcaaatttacaattttagtgacccaaagaagtgtgaacttgtcagtgataagtgaagaaattctaccactctgtggggctgcagaatgcccacataatttggaacctttagcagccaaacagattgcacaatctcaactagcgatcttgaagcatgtctgattttccacctggtgagaagaagcctgagttatggggactgtatgagtgctggagtgctggcataaaccaactctgccaacttcttaacccataaacaattatgaataatgatccaaacagcatttaaaagaaataattagacactgcactttaaaaaaaaaccctcagtagtgactaaaatctagtcactggaatgagtagtcaggaagttgttgatcctccgaaaaccacggcttagttctaaaaacagccttaaattgcagagaacctgaccctgaccttcaaatcccttgctccatgaggaaatgagactaccgcctcctgagtgctatagtgtctgttctttcagagattgtcagtaagttttacaatacaattcctgtttctgaggctcattagatcttccttatttatacggatttgaggcagtacttgcttttgtgtgatagaattatctgttggtatccgacgtcagacctattttctacactctaacatattaaattctgccttgtttgtttctaaagcacctcttaataccaactcagccaacatcacctgtgctggaggtggttaagatccacctccccaatgcatgttaccacggtgacaaagtagtgacctaatttacacacacctgctgggttaattgggccaaaatgaaagatgatatatatgctcaaaatccaaaactgatttttttcctcaaaattaaatatttgattttttaaaaattagcagtttctaaagctaagtaacatactccaggtgtgcatttgccagttaatgtaccctgaatgtttcatgacacttgaggagcaaaatatattgagtgatgaatacaaatcttttatgtattttctgtgtgcaatgattagtatgagtaagtggtctcgatcactgaatacatggggtgtgcttgaagggtcaggccactgccttaaagcaaacagagacatctcaactgtgccaagttagcacgcagagtccgggccgcctttgaaagtgcaagtttgctttggagaaagctgttctccatagcctgaggctgcctgcaacatctcttagacaaaaacatcacttacctctgcttgacctcttcccacctctttgtattcattcttcccagaccactgagagtttttctttgaaccatattaagttttatgccaagaactgatgaggatatgaacaaatagatactttcagagactgctgggacagacacagcaatgtgtaaatggtatagctaaatgtatcaaaacccttaaaatacatatatctttgattcaattattacacttaagtatttacctgatgacataatcagggatgtttataaaaaagattgtcacaataatattcattgtaattcatgtttactggagaaaaattggaagcaacttacatgtccaaaaattagagatcagctaggtaaattataacacatccattgtatggaatactatataatcaattaaaaaaatcatgtcacaaaaaatattgacagaaacaaatattcataatatattgctagttgaaaaatcagaatcataaccttgcataatcctatgttgttgcatgcacacatacatatacacaccaaaatattaagaataactttttctttaagtggtaatagtaatatcaatggtgattttcttgtcttctttctgtctttttgtgttttccaaatagttttacactgatagcgtactacttttagaaaggaaatataaatatgatattaaaaataaaatgaagagtaggaaaaaagttaaatgacatttcctaatccctctctcctacttagatttcacatttcacctatatttacttctctccttgtcaactacagatgtaaatataatagatgttaaactggtcaatgttcttttattactgaatattcaacttttctagctgaatggatctttcacttatttacaaatcttacaaagatgtcagtcagcacaactcttagaaagagtctccaatctgctttttatgcttacaaaaaccatgtgaaataattgccttttaataacaatgattacttgaagtgaacttttcaaggtacaaataaatctatttatcaccaagctattgtgtcccgcttaaattacaactttcacattttgatttcatttgtacagatatagggtcttactgataagtaagtgcttttgttaagtaaataaaattagtattaccatatgaactggatttgctgttaaaagtatctcactaggggtttgatttattctatgatggtttcactgatttaatcattgcttaaattagcaaaatataattatatatttttataaagaagatgttttcttgggattttcctatgtcaccaagaatagacatcagggattgataagtaataagaaatgtcaattttaaaattacatttcttggtctaatatgctttctttttaccttagtgatgatcgctgccttcctaaaaagttcataaagcttcagaaaaatctaaaattcatgaaatttcaaagaattaaaaaaattggtgcttttatttcaagtgataaaattaaactttattttcattctcaaaaataagttttggttgaatcaaagatgtaaatattaagagactaaatcataaatgtgctagaagaaaatctgagtaatttttctggtgtaagaagttttctaagccataaaggaaattattgaaaaaatgaaactacataaaaaatttttctacatatacaaaactcaaaaagcaaattaataaccaagaaatatgtctaacacatactacagaaaatttattttccataatatacaaagaggctatacaaaccaataaaatatttttaaaaactcaatagaaaaatacagaaaagtattatagccaattcacaaaaaagtaaacaaaaatgtaaatggccagtgaaattttaatatgttgtttaatctaactcctgagtaaagaaatgtaaatcaaaacaatggtgaaatatcattttcacttttctgattaggaaaaatttgctaaagcccagtactgatgaggctgtgagaaagcaggaattctcatataatgttgttacatgtgtgtgtcagaaaaatgtttttgaaggaaaatttttaacaggcatcaaaattttaattatataaacatatctaagaaagtatgctatgtggatattaaaataaaaacaaggatatatttagaaagctgttttgtaatatttttaaacagcgaagaaactgtaaataaccaaatttccataaataggcagtggttaaatacattttgtgacatccataaaatggaaatattaagtagctgtttaaaaagaggaaaaggtaaaatataatataccaaaatataaacactataaaatttctagaatatataaaatctctaagacatggcattaagaaaaaagtacaaatgtatttgaacagtatgattccctttctgtttttaaattaaaggtatatagacacatttctctacgcaagtacagttgaaactttttatctctggtgaatagtgctatcagtcggtaaagacatacttttcactttatatccttgtgtaccattcaaattttttaaccctgtgagcacattttaaaaatacaaatagcagaaagattgttcagtgtaatggtaaatggtgaaaggtatatacatggaagtaaagagtactgcactgttaaatttctcattctagacttctctagtcccacagtaaatcattcaacttcactgggatttcatttcctcatttgtaaaataataattaaattagctcaaagaataatctgtaagttaccttatagttctaacagtacatattttcatgtgttaataatccaatacagaatggtggaaaaatatgtttgagacttaaatatcaattttgagcacctgtacctactacaataaacaaatctctacttggtattttgtatgtagactgtagccatgtctttatgacaaaaacaaacaataaatgtactgaaaattttggctcattgaataaactaaatattatcttaaagaccatccccatgcacaagtacctctgggtctcaatggtttagttctgccaaggtgttgaaacaagactatcaaacaaaactgatcagaaatgtattacttacatacttcactgccaacttaaagccacaaccacgaagctgacttgttgaatctaaccttgattaatgctctcatatatacaaaataatgtcaaaatatcaacattcatttataattcaggtatatattgccacaagcactcttaatatgtttttgatattggataacctgatagtgcatgctcacaagttaaaatagtaatatccatcttgtttttaatttgtggtacttgaggcttcagtataataatggccttcttccattgtgacttaatattcctatcatttggttatatatttttaaagcaaaaatctctcgatcgttattcagatgacaaattatatggtcatatctgttagatacagcaaagtctgcactgtggtatttctaagaaagcaagtagttcattccttcatttctgggttccattgtgataaggacagaaccatgggaatttccttggtaagattcaaggggtataactggtaagaatggtgtgttctttttttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtgtcgatctcctgacctcgtgatccgcccgcctcggcctcccaaagtgctgggattacaggcgtgagccaccgcgcccggccggtgtgttcttaatcacacaccataggtacatttgtaaattaggatgtggctaaagcctactaaaaagtatattgatagatttttagtatctgtagtgaaaaaagttagattctcacatctaaaaacctcacaatttctgaaactgtcatctgactgtgtttttcaaatgttcacagtagacggcctacttccttgtgcattttttcacatagtatcagcctgggtcatggtaatactgttatctggtataacatcgagcaatgggaaaataatgtggtgaatgaacagttgattagacacattaaactaaggaaaattcaatcaaagatcatcagtttcaatgatttactaccatacatctttgcttagctatgaataaaacattttgaatgaagcttttggtgaaatttctgtttcaagatgaaagtagaaatgagaaaaatagacatcctgtgctcacctcaaatggagagataactatatattccgaaaaagttctatgttaaatcttgggctcctatgagactaataaaaaaaaataagtttaacccttcattttcagtttcagtcttgatatacagaaaaggaggaaaagggctgatactactacttgaagaagtgatttgcgaaagggagaaatgatggctcaaaaacccctgtagctcctctaacaaaccctggtaccagagcagacaatgaaattgctagggagagctaagagtagcaatgaattcaatccctccctttgtggccaaacttagttctgctttcagaaataacaaaatttcaggagatatggttaaaatttataggatatggcaaagtttaaggagatttggttaagcatttttaatccattcccaaatgcttactatggctatatttagtaccaggataaagaggaggataaactggttgcccctgaagaagcagacctcccaactgtacattgttaatagttgacagaacactcctcccttgccacagctactctaatacacacaaaccttggatgcacaactctgtgtaacctgtaatgatttagagattgcatttcttgtacacaagatcttcccttgaatggctccttcacgtcattcaagtcttataattcaaactttatttcctcagaaaggacacctacaccctgcctccggattaccagccattcttcatcctttttgttgtagttgtatgttaatttgtttagtgtctctctctcggtcttctagttcagagctctgtctctagtgcctgagatcaactgaattgtaattatttactcatgatagaagagtaatcaacaccagaaagaaatctgctatctaacaaaataatagtttcttcttttttttttttcggcaacagatacaagacaaactaaaacaggttaattcaattaatgtgttttgggtgcaaatcccagtttggtattatcaaaggcatattttcacatttaactatattatcatttcagggattacttaattttcattttcatttctatttcatcctttcttttctggcagggaagcctaagctcatttgtaaaatttttctgtcctctgagcatacaattatattttatccagaacagaagtgcaccaaaagagctgaaagttaaaagaaatgttcagtagatgagacctataatactggttctgattaattaatataatcactctattaattatctatgtttaaaattcaaatttatctatgttggcttattgagcattcttaaagaaaacatacttgtaatatcctacaaccatgaggtggaaagggtcagcaaatgcttccaattatatcccaattattttaggaatggtttacttcaccttctgctccctctacccactcaccctaatagtggtctgctccttacttaaaaggggaaaacacaaagatttcctgcagtttgagaatcaacttgggagaaatagaaaaacaggtgtctgagttgagcagagctgagtttagtcctgtgtcagccatttactagctatttaaagttagaaattaactttctgagccttgggcttgctcttttaatctagacctggatattcatgattccagtgttcatttaatggatgtgtatttgtacgtatggccatatccatagttctctaataaagacctggccgatgctaagcagagaaattagacggattgtgatctcaacatgcagtcatccagcacaatacttttgtccatctacgacactaaatttcaattgtatacttggcttatattatctggagatcattacgaaaaacattttctgcaactcttgatttacttaggtcacaagtaaagttatgtgaaagtaccatggactataagagtatatttggcatctcaacacacatggattgacagaaaagttggatgataccaatgtcagtttttagttctgcagtccatctgcagagttagtgactgttggttacctattctatgcctcaaccttgtcatctataatgagaagtttcagtagtttaaaaaagtatgacagaaaatgattcataattccatgaaattcataaaaaataccaaggtgctaaggctacaagtattctaaaaacagaggacaggataaactttgtcaaataccgaggggaaaaataattaacatgttagcatatgtcttagtctgtttcctgtcgcctataacggaatacttgtaactcagcaatttataagaaaggaaatttatctcttatagttggaggctgggaagtccaaggttgagggagcaaaactggtgaaagccttcttgccgtgacaacactctagaatcctgagacaacgtaggacatcacatggcaagggggcagactgtgctagcgcaggtctctctttatgtttctataaagctaccagtcccattcccatgataacccagtaattcattaacccaagaaaagactcatccattcatgggccctcatgacccacctcttaaaggccccagctctcaatactgccacactggggcttaactttcaacatgagttttggaggggacaaaaattcaaaccatagcagtgtgtaaataagtcttccatagatatttactaccaaaaaataacattactctctatagtaggttgaatgttgactagagtccccaaaatttcatgttcacctggaacctcagaatgtaacattcctgggagatacggtccttgcagatgcaactaattaagaaccatgagataaaatcatcctggatttaaggtgggccctaaatccaataactgatatgcttttaataggaggagaggacacagagggacacatacagaggggaaggtgctgtaaagatgaaggcagagtttgacgtcatagtgccaaaagccaaagaataaatgggaccatcagaagctggaagagccagggaaagattttcactgtgagccttcagagggaatgtggccctgctgcattttgatttctgatttctagcctccagaactgtgagagaataaatttctgtcgtttttaagtcacccagtttatcataatttactacagcagccataggtaactagtacactttccctgtactctctaggactaaaacagaggaagacatacagaagttttataagtgtaaatagtgatctcaaagcccccaattgataggagcacataaggacaaataaaaatcaatgagaaaacttaagaggttgcagtgatggtttctggtagtagtaagcctcaaacgaaatgtactgccctctatttggagctgttccctcttaaatcaaatgcagatgccctccaaaagtgatgcaacatcttctgatccaatcctttcaagcaagccagaaactgatcttaacgtggaattggtcattaaaaaaaaaaaaagaaagaaagaaagaaaagaaaattaataggctgggtgcagtggctcacgcctgtaaatccagcactttgggaggctgaggcaggaggactgctggagcccaggagtttgagaccagcatgggcaacatagtgagacccccatttctacaaaaaaaaaatttaaacatctgctgagcatggtggtgcacacctgtagtcccagctactgggaagctgagatgggaggactgcctgggaggttgagactgcagtgagccatgatcatgccactgcactccagcctgggtgacaaagtgaggcctttatatttttaaaaatccaagtggtatattgatgtaaataattaatatcttacaatgatatatgatcaatagcaaaagtatactggaaattacttaattggacataaatcagttctcaaataaaaaattatttatgttcctgaagaacttgattcagagagtaaatatacctatttttcatcaatggaaatttaaatataatatcagtaacaaatttacatagaggaaaatcaattttattttggtctagagtatatactatcatgagacttggcaaagaccctaataagtatacagatcacggcttgaggcatcagatcagcatgattaaagattatgtttgaattgtctcctgatatacaaaattaaccatttcttaagtaatactaaactcagctatcctatttgctacacaaatttaagccattatagaagcaacattttagttaattttcaatatctctatttactttctgtgcatatttttatgtacttacacttaaatcttaactttcagatagtcctaccttatttaatttttttacctttaaaaagtcataacctgtggtataatcttcttttgatatgcttaacaaaatataacaatgaaatgtagtgtaaaaagtttaaatacttttaaaaatatatttttaaatagcttaagaaatatattttgaaaatatattttacacaaatatgaatgtgtgaaatatctattcacacatttttaccctaatgcacagaaatcctttcgtttagaaaaatagaaattgtattcataatttcccttaaagactctcaaaaccataaggatgatacatgcagatattaactattagatattacatgtttaaagcaggaaagaatgaaaacgttaacttcctagaaaactgcaaatatcaaattctttttcttttggttttttaacttaagagttgtgcattaattactattagtaattaattagtcaccaaatattctaaaggtgggaacaaaaggttcttacaactcagagatgaatctatttatatttgactttttttctcagacactggtctcctaacactttataagttcaataagatgtgaatatagataattagggtattcctatataatcaggtagaaagtgaatacatttgtgtcagtagctacaataatttgcattaaatgaatgagtgaataaaaaataaatcataaaaaggcactgtttgggattggtataaaacatttacttttaatacataaattattaatattaagcagttatattacaaatgacagagaactgttattgaggtgcaaataactcaacagtaaatattagccatgactaggttatagggtgtttctggaattcttgcttctttttagattagtataatgctctactcaaggtgtagagtaaatctgcaataactagagcaaataataagtggtagaaaaaaaaggatctatacagaagaccatattttattacatggtttcagaatagcattatgattatgatgactaatgagaggaggaagaagaagagatgtttttaattttaaagtgctttggtatgttgtcatctctaatttacagatgaggaaactgagcgtaaaagcacacgaagagctgcctatatctcatagccaataagtgataacagagaaacttaaatccctctcttctatttctaaaccctgtactctttctactctattatattgtctctttattccctgaaaccagagatatgtattaacagtaaaattcttaaatactgcagttaaaatagaaattcctccaagccagtgttgaaagcaccacagtatttataaaaataaaaatcagcttcttaaaaaattattgttcttaaataaatttaaaaagaacaaaatcttctttgagttcccctatattcctcatacagaatcttggcagtgataatctgcaccgtaaactgtgaagtaaattgtgtatgtgaatgaaaacaataagaacctacagaaacacatgggagatctaactcggataggatggtctgagtagcgtagggacatggatgaagctagaaaccatcattctgagcaaactgtcacaaggacagaaaaccaaataccgcatgttctcactcataggtgggaattgaacaatgagaacacttggacacagggtggggaacatcacacaccgggcctgtcctggggtggggagacgggggagggattgcattaggagatgtacctaatgtaaatgacaagttaaggggtgcagcacaccaacatggcacatgtatacatatgtaacaaacctgcacattgtgcacatgtaccctagaacttaaagtataataaaaaaggaagaaaaataataataatattatcacatttcacagagtttacagtctggcggaggagaaaaacattaaactaataattatataaccacttatttatttacacctgaggtctattcgttatctttgactatgccacataattccaatctgaactcacttgtatgcattacttagcttggcgatgcttgatgttctcctttctatttccttatgtcctatgcttcatgtttttttcaaggcccagcttaagttcagcctcttcccagcagttcacagagatctctgcctccactaaatatctttagcacttaatgattctttttcaacaatggcaaatgggtttcctattacatgaaacttccaacaattggtatggctgtcaaagtactgtcttcagagggactctgaggtcaagttttggtgtagtgacagagacagccataatggattagtgttgtttcatggacagtgaaggggagacaggggatgctgaatttagaacattgacttcacaaatagactgcctaacttaaaaaaaatgtttgtagcatttattttacaccaaatccaggtctaagcatgcaatttgacactgagagtgccttgttttattttttaaaaaacctgtatcatgtctcctcaagtatcataagattcttgcatgtaatacttctctatgctcacagcatgtagtcatgccttgaaacataggcatttgctgatgacaataaattaccattttagaattcactcttattactattgtgaactccatttatgtcatagcttctctcaaaatattatcaatattgaacccattttagaaaaactttgtaacataagctataaaatgtaagtaaatatattgtctttaccatgaccagattcaaattcaacattaggatattgataacacttaacgattaaatatatacctgccaaataataaaatgaaacaaagagaagataactacttcttaaatgagtttaaacattttttaaaaatccagccaggcgtggtggctcatgcctgtaatcctagcactttgggaggcccaggcaggtggattgcctgagctcaggagtttgagaccagcccgggcaacatggtgaaaccccgtctctactaaaatacaaaaaactagacgggtgtggtggcgggcacctgtagtcccagctactcggaaggctgaggcaggagaattgtttgaacccaggaagtggaggttgcagtgagccgtgatcgcgcctctgcactccagcctgggcgacagagcgagactccatctccaaaaaaaaaaaatatccaaatctgtgtatttcaaaatatattttacatacttattatgtcctaaaatttgtatctctcttttagtatacttcattttcctgcacatagtaagtgttgaagaaatccacagtggttagtttagaccttattttagagagatagctccattttacattccgtcttgctaaggaagtgtattcatcatattccataacagctcacagtttgttatacattaactgcttattctctgtgccaataagactgtgctggaacagcaaataaatttggtgcattcatttaaatgattctgcaaaccacaggctacccagttgtctaatgataagagagccccaaagccacctgatcaccattatactcccttatttttttggatttgcatggtcagtactgtcaggatctgaatacagagaagaatgagaagtaaaagtatacctcagacctaatcatgaaaagggattttattaatttcggcaccagtgatgatgtggctaggttggaaggggaatgggatataagatctggagtgctttatctgctccaagaccaatgctggttttggcacttctctcactctagtgagttgcaaaaaaacaagcaggtgctagcaatctgagagaccacatgccagctacagctgcttcaaactgattcaattacatctgcctgaatagtcccaggacatcaaactagttgaagagatccataggttgcaaggagactttgtctatcctgatggacaactgtctctgagataatgacctgcaaatttccaggttgtgatataaagtgatcattccatcaccaggcataagagaaaagatgggggaatgcgatgttttattcactttaaaattaaaaattggttgtagaaagcacaaaggcctctttgaatttaaatctgaaagtcactgaggccttatggataccttgaaacagcccaattttgtgagaacatttcccaaatcattgggtacagcacatttacagaacatgctcttgggatccggacttcgctccaaaccttgtttgtacaaaaaggggccaagcagctgggaaattctggagtggagtgtgtcctcattagttcccatctgccaccagaactcagctcatggcaagtttggctaagtcctggtgtactcaggtccaaatgtgggtcagttttaattacactatacagaattcagtgtgcagttttaaaatccttattatacagcacagaggaatgggcagctctccagctaatcaattttttaaaagtacatatataaaaattttaaaccaggctagacagacagtgggtggaaaaaaatctttaaatgagtacaagggttacttaagagaattattagtgaaattgggtcatgaacaagttctgctttaaagcttcaaagtgagaaacaaactgttttcattggtaagttggaaaacttatgtaaggtacacaatgtgccttgctctttagtgtgaataacaataagcctgtggccagggtacacaacacacctacaagtgaactggctttcatgtaagcagaaatgttcccaattttgtgactcttcactccatccccttttgatgtttatcacttatggcaaagactggataaaagaaaaaaatcacaagctacctggtaaatagtgaaaaaaaaaagatgaggaaggggagggagtgagagaaaaggagagtagaaagcacaagtgctgagtagcagactctgggcatgacttgtctctcagtgccatccatacaaatgggggccagaatcaacgcttgcagtctatgttcagattccatcctgtccaaaagctttatcaggttcaggagcgctaaaacactaagccttcgaagacaattgtcagtaaaaaattcaggagtaaacacgtcggcagtcagtgattaggcatttatgcaccatttttgatagataaaatgtcccttgacacaagtcctaatgacaacaacaacaacaacaacaaaacacaaaaaccttaaatgttcaaagtatctttgggcttttgactgagtttttatcaggtttatccatttaaaagcagcacgggatgctaggttcaaataccagcattgaatatttacaagctatatgactttggacaaattgcttatcctctctgacattttgttttctcacctgcaaaatgggagaaataacatcttcctcacagggctgttgcaaggatcataaaacatatatgcatacatatattggatattacatatctatatatacatacatgcatatatatacatatacactcacataaatgtgcatatgtatatatatagcatctggaacatgaaagtcactcaataaatgttaactatcattaacccagttatgatgaactaaattttgttccccaacccctccaaaaaaaaacatgtgttggagttctaaccccaagtacttccaaatgtgatcttacttggacataggtctctaaagaggtaatcgagttaaaataatgcaattagggtgggcctgaattcaatatgactgatgtccttataaaagcagagaaatctggggacagagacagatacttacagagggaagacagaggaagacatatggagagacataggaaggagatggccatctatatgtcaaggagaaaggctggaacagatccttccctcacagccctgagaagaaccaacctggctaataaaccttgatttcagacttctgaactgtgagaaaacaaatgtctgtttaagccaccaagtttgtggtcctttgtaatattcccaactaaataaaaattccattaatcatcaatatttaccttgattcatcatggtcgaaactatacatttgatattaggcaggtctgtattacctctggtgagtaataatcaattctatatatattatctagtgatgttttcattattttaaaagaatccttttctgattgctgtacaagaagatactgctgcaatataaacagcctggcagaggaaaatggtttactataattaagatcatctagttattattaaagataattaagggaaaatcatacatataaattcataaatccacttttctactgttgagtttgcatagaaggaaatcagaaaatcttaccacactaatttccttctcaagaaaaaataaaaccttacacagcgatttatgcactgacaactatgctcactaaacctgaggctgcttagattaccaacaggaccacttttaagtcattttgatgcatatgaaagtaactcatcaagcatgggttcttcatcctttgcaagagactgcttttaaaggtatctgactttcagaagagggatgagagttgtctgggttgtgtcaacacgctttctattgcaagacatacctccataatcaacagacattgaagtgaatgtgagcatccccatcttaagtttttctttaaacagccctagccttctatagaaatgtggcatgtatagttagaaattatgagtctaattatgttgaactgagataagcaacagatatcacaagagccataattggaccaaagttaactttcttaatgtatgtgtcccacacttccttgaaattcctatactactgattataaaaatttttatattttgtcaagagaagagaggaaaaaataatacacagagactactatgcaataatacataggtggtagtggtgcacaaaataaagtattttgtatacctaatttactttaatccacatatccaccattaaaaaggtaggtgttgttaccaccatactatacataggaaagcttgaggcttagtaagctctgccaacctcgatgaggtcgcacagctactgaataatggagctagacttttggtaaaggtcagtgggagggaatccaaagctcctaaattcaaactcaagcatgagatttacaatccagatatcctaagtgcatcactgggttccaagatggtgatttatttaaggaattcacaggcgtgttgaaagcatttgaactcacataagcagtagatgtgttcttgctaaacctaactcaacttattctccttatgaggaaatcaatgctattcacaaacacaacctaaaaggctttattcaatttaaatgaaattaatcttattataagaacacatgaaaatggaattaccatacaatctagcaattccacttctgggtatatactcaaaagcattgaaagcaggttctcagagagatagttgtacacctatattcatagccaaattgttcataataattaaaacatggaagcaatccaagtgtccactgatgagtgaatggacaggcaaaatgtggtatatacatgcaattaattattattcagccataaaaacaaggaaatcctgacatgtactaccacatggatgaatgctgaggacattacgctaagtgaaataagccaaacacgagaagagaaatactatatgattccacttatataactacatagagaagtcaaaatgacagagacagacactaaaatggtggctgccagaggctgggggtgggagtgcagagggaaatgggaagttatattttaatgggtatagtattttagttttacaacatgaaagtgttatatagagatgtattgtggtgatggctgtgcaagcatcataaatgtatttaataccattgaactgtataccaaaaaatagttaagatagtaaacttcatgttgtgtgtatttttcccaaatacaaaaatttggggaaaataataaaaatatcacatgaaggtcttttagattcagtacattgcttcatgatttttataatatcttctaaggccagggaagcagaggtaactttgtatagaacctctgagtacaatctatgtgataatgcccaaccaggatccctgctcccaggcaattagatgttcttttttcagagtctaaactgcagtagtggtgatggcgagggaactggtagtgatagaaatgacagtagcatagctaagatttcttcagtacttgctatgtgccaaccagtggaccaagaatcttacatgtagtgtgttattaactctcagacaacagatactattattttcccagttttacaaatgagtaaacaagggaacagaaacattaggtaacttgattgagaccatactaataataagtggtgaagtcaaaaagaactctattgatatatctttgtctctcactagcctgtatcctcttgagaacaaagattttgttgtattcatctagcctagcacaatttctagcaaacagcagacatccattcaccatgcagaataaaaggaaatgaggaaaggagagagggaaagaagggggaaaaaagaaattatatctagtcatgctatgttcttaataaatgtggattttctttctttatttccttaaccctgaaatcgcaggggaacctgcaataatgctcaggaatcctagggcataggaattcctccctctttgagattccaggctaattcctgacacaggaccctcaaaaagctgctaatatctgtctagtttaatgattaatattctagcaaatatatattcttggctcatctcctaatttctaatattgagactaacagagagatagagttcaatctaccacactaagattcactggaaaaaaccgatgtctttgatattggcctcttgcacactggtgtgaactgaggtaaaagaaaaactgttcccagaggaaaggtagttccatgcctaaaagtacatgtgtcataaaccagtggtactaaaatttgagaagcctaaacaaaaggttttaatgcaatagataactggcttattatgtaaactgtgccaatcttatgtgacgggcttatgccacacaaaacggaacattagaatgatctatctaaagcaagtcttaactgttctattttgactctactcttgcttggctttacctctatttataattaaaatttagtgagtcatagagaccataattataaacatgtatacagtaaacacagggtccattacttttgcttagaaaaataattacagattttttaatattctgatcttaactgacccaaaggaattaaacacacattttatttttgtgttttagtgagatagagatagggagggagaagcataagccagtgctcaggaaagacgaggcattaaccatataacatagatttgtttatttatgggctgcaaagtatttccaaggtgacaagtaacttagccattaatgcctcagccttatgtgtataatgggaataacatacagacttcttgtaataagtaaaagttagtttaaagcacattgcaaatagtgttatttcaattattcattaaaatagtcaaaaaggatcagttcttatacattaatttctcattttaaggacagaatttatcagtattctcatatctatgtaactggcagtatgagaactaaaggccatcaagacttatctaaactgtataacaagtaataagattttaggacacaatccctctatttctaatacaactccagaaatgttttattcataaatgcattcattcaacatttactgatcaactactatgtacaaggcattgtataagaggctgtggcaatcctctacttacctttgtactgtgtttcctacttccaaagaggttaaattaataccaaagtgatttgttaaaaatacaaaaaaggattccaaatgggccaataaaaggaaaagacacaccaactctaagaccagatttatgttactaaataccgacggaaactcctcagcatttaaaagaatacattaaggagagtaatgcaagtcatttggatgttttcaatatgagaaatttgagcctactgaataaattaattaaatatctttaatattgagttgcagctttttattgcatttatagaactttacctattagtaaaatatacaatctataatagcttgtctatatcaaaaatatagatatctgtcagaaaacatacaaagccacaactaaaatacatttaatatcattaccagtaacatttgtgaaaaaataccaagcatctagcatttgttaaattaaagaataatattccataaaatctacatctggattttagcccctcttttagaattactatttaatcttcactttttttctctctcacttctaccccaacagcaacagaaacacatgcacaaattaaggaattatcttacaatatacccttaaattttctgaatatgccccatgtgtccactaatagccaaatgctttcaaatctgttcagctaaatggatcaataactacatccagcctcacatagtggggctgccaacacggtgaaattgagccaaacacaaaatgtctctaccaggacaaaaattattatcaacccagttatctgaagagatctactctcccagatattctttcgagaagttggcatacacattatctagggcagtcaacagctactaaaaaaaaaatatttgagtcataaaacagaggatttaaagaaaatattcagaagctaaaaccagtgagttttagaataaaccaatgtaacagttcaaggtctacatcaagtaagaatctttcagagtcagagtacacaaaacacgtaagagcacaagcacactgctaacaagcttctctgtgctctcactcatatgacacagctgcaagcaacaattgagcaggtgcaaccaagcttttgagaattcctgcctgttgcccaggaaccacaacactgcatggttgagattttaaacaggtgcaaacatttttttttcccattcgtctagtgcttgagacagtggagcagacagtacatctgcaaccactccatacctaaagcaaccatcacagaaaataaactcaaaagcagcaaaataaaaaaaagtttaaataaaacaataatggcaaaactgtggttttgcaatggtctgaccccacatcaccgttcactttaatagtacaattccataaaataatctcttcaccagatgaatgctttgtaattaaaattatttgccttatcaaatcttagaaatgtttacttgattcttacaatagaataaaataaaatatatgtataaaatgtactatcctttgaagctgtcattatctgtaagtaatcaagaattaacatttttacattatgaaatctataagcaattttaatacataaaaatattataacttgttagttaatatatagatttacatagttataggtaattcatatacatacctgtgcagctatggggcacaaacttgcaattcatcaattctgaaatgtaaaagaaatatataagtaaaaattaatttactaagttggaaccagtatttatgttgcaacaattcctgcagagaagtaggaaaagtttcagtgcataaagaggtaaattattttttatcaatattttccctataggatatttcatatatctgaaaatatatacacacacacacacacacacacacacacacacacacagagtcccttagcagtgtatcataagcactagcaagggactctgactcaccatggcctctgaaactcaaatgctttcactagaggacgaggcaaacactttaaaatgatttttttttttggtattcttccaagactattgccttcctaatacaaatatgactgctgctctctaaaatgaaactactcagattcatctgcactcagtttggatagaatgttgttaaggaagaaaggtgcttttgtagagcagtccacaaaaaaatgcatgaataaatgaaagtaaactttgaatgttcgttaactttgagttacaacagcaaatagaaatgaaattgattgctacaagaaggaatgctaacaccacgtcggatataatgcaaaatgcctcaactcaacacactttgacaaaactgccagcgaagtaggtattgatacagaagactatgtaagtccacattaaacaaaagtagcagtttacaattagacctgaaaaacatttggatttaggtggaaactgtattgcaacatacagcctgggaactactggtactcttaaaaatatttcctagttctagccaggagtggtggctcacgcctgtaatcccagcactatgggaggctgaggtgggctgatcacctgaggtcaggagttcgagactagcccgagattacgctattgcactccagcctgggtgacaagagagaggctccatctcaaaaaaaaaaaaaattctttttgaaagcaaacggacatgtttaatttatatagttcttctgagcacagtcgattacagcaacacattatagtcagtaagtccactttataatactgcttaaaagtatatagaggtaataattttgatgatggctcaataaaacaacatcttcgtatattctgatgggaatgtggattacaaaagactttctagaaacccactgagtactatgtatcaagaacccaaagttcaatatttttactcagtaattttagtcccaggaatcaaatgtaatagaaaaccaacagaaatttatgtaaaaaagataatttttatgacagtaaaaaactataagcaacctaaatatctaatagaaaaataattaaataaagcatagcacatctatataaaggaatatttggcaaaatttaacaaggtactttaaagaatattttaaattttacggaaaaatgcaaatttatagtattatgatgctaaaatattatataaacatgtagactaccaattacatggacagtatgaaattatgtgaataagaaaaaacaaagaacaaaacaaagaattaagagtgattatatctggataataagactttggatgattttaattttttctttttactttcatatatagttaattatctacaataagcatgacttttataataggaaaaaataatagtaggtagggtaggggtaaaaggaaaaagttataaaatgctatattgaattcataaatgtaaccttcctaagagaaataaattaattcagtcacaaataaaacccagtaactgtgcctacagtgagaaacaccctcactgcttcctcaaaggggcatagccagggtcttttttatcccagtgctttggaatctacacaagtaattcaataacacatttttaaatcatcttagtaaaacttctttacttattatgcagagtgaaatgatggcaagaataatttaggacttcaaatctcttcaacctagcacagcctaacttattcactaattcaatcacattcagtgagcatctactgcctgcatggtgctgtgtttggcactgcaacgtgctaacagataaattaggacacaccttaccctcattgagctaacaatttaaaaacactaaaaaatgtttagacacagctcacatgaagaagtaaacacaatacagttcaaagcatttgtgacagatttggtacattttaaagcaagaaaacatacactaggtttattttttatatttctgagcaaacacctatctttaggtaacaataaaaagtcatgtgtattagtatcacttattaatgcactagcaaattaagtatttaagttttttccttatgtgatctattttttgttaatggacagttacataataggagattaagtatgaaggaatagtgacccaatctggaatgcagatgtgtaagattgtctcagtttatctgaggccacataaaacacatgcacaattattaacaggctgcagttatttattggaaaccaaagcaaataagttagttactggttaatcctgctaaaagacactgttatgacaacaccaccagggaaagaaaagaagatagagcaaaccacttttgttatgcagataaaatgattcagcatagagattctctcaatagcagttcagtttcctgctggcctgtaaacataatcagcaatgcccttctgaggccagtgctgcaggattattccaatgtgaggtcaatggggtcaatctgtgtgaagtggtgacaaacactaagagaaggtaagaagctatttgtgtgatcagtgatccatagactggggctcagagttctgggaagcagtagagttatgaggtagggtggtagttaagcacttagcttttgccatcaaacaaacctggaatcaaattccagctccccatctttagttctgtgatcctaagcaatttaaattttctgtctgtaaaatggtgatcatgttactcaccctacgaggttgtctatgcaggttatatgttatagccatataaaggaactagcacagtgccagccatgaggtaagcatttgataaaagggaactgttagtactatcatagttgtatgaaaagggaaagcatgtctgtccctttaagctaaggaactaagctaggcaaggagtaaggagataaagaaggcttgttgaagacatcaccctacagtccagcagctcatccaaaagccagtcatgtgcttgatgttcacagaacatttctgaatcaggcaacactgcaacaatagtaatagccacaataacaattctaaccagcacttttaagctccattcctatgactgaaaagaaaggcagtaaagtctaaataatacgtgcagcaacactgccgaacttctctgggtgaaaaatgaaggatcactttccacatttaactgaaacaatcaggaaaaggaaaataaggacaaaatgaatataattactcaactggaattggaccaaggtgccgtgtaatggtcttagcaatcacatgtaggcacttatcacctttttatgtattctaaggagatcctgcagatgaccagagccttatatatgaggtttgcaactctaagtaaaaaaaaacgttagagtcagtttttttcttatggctgggaagacagaaatggatgcatactgatgttgttctagtccttatttgtgttttgatttaaaggacagcacagatcctgagttgttaagtggcgtgtcttcagattcccacacagttcatgtaattgctagagttgtttcactcgcattgggtgaagttactattagcaccattccagatgcagatatactatagagtgtttgtttgtttgtttgtttgtttgaagttctttttacttctaggttggcatagctgtgttctccagtgggataggtccaattctatgttacagaatacagaaatagttcatcttcccttcatactagttgggcctggctagagatgccccttaagccattaataaatctacttgctaattcacttagagtactaacaaggatctcacctgggcctgtgggtacaaccactccatagaagagctctaaacctaaatttaaacaaaaagaatttcacccatgactgaggaagcatccacaggactattttacatgctttacatttaaatttgatattttgagagaagactatgtaattcaaaataattttattttatttaatatgtatttagtccttctggacccactacagagctggatgttgtatcattattatatggttattataaaatgtacactttactcatcaataaagccaattttacttttgaaaattgaggtacctggcttctgtggtttctctcaacagaaagtcctatgaagagtaagaactataaattgtcaagtagacttgaaaaacttatgcttattttgtaaattactgagctaggtctggcccttcattttgaaaagctatctgcctataagaaagaggaagtatgaggagcacagttatctattaatcaacactgtgaactggaaacagataaagtgcaataaagaaggaaaaggaaatcatatggtaaacaccgttaacccaacggcacagttgatctgtctagaccttaggtcagataagctgtaataaagctataaaatccacgaaaaactaaagcttatttacaaaaactgcaaaatttgaattttctataattaatgccacttaaaatgaaagaatttaatatcaaatttcatgtataaacatgataaatttgaactctcaagtagaaacctcatctacaatacactaagtgttaataattctaattgtcctataatccacacttcacagcatattctagagaaaatagctgttgggtttttatgacttaacttaaacttcacaacttttaaaataaaagtttaagagctaatttaaaaatgtatttaagaacctaaaatttagaaaatattaaaaattatattttcaaaatatcctcaacttgaagttatggctattgaaatcaatgatttattctcagaaaatgtgaaaattttactggcctgcttgtatacatccctggggtcttagtttagatattatctcctccagaatctgatatcctgtgtctaatcctgtcataataatcattttattgcactggaattgtcttttacataagactgtaaacttggggaccagcatttgtatcttattcaccattacatctgtagtttttacttagcacagtacataatgtgtggtaggtaggtcttaaatattggctaaaggaatgttgcatgaattgtgttagcttgtattcttgatgattaagaaaattcacactgcataaaaaattaaggaatcacattcgtaaacaagttattcccaatctttaaaggactaatcttccaatctattttcttgtgctttttctacctatttttcctcttaatcagtacaaacttaaaatatgagaatttgagtctcaaatgttaacaccaggttagaaagcctcgttagtttggccccacattggacaagaatgagttgtccaaatcctacctgttaacagatactcggtatggaagaaactgttacacagagttcactgaaagagttctgcagttcctaaccaattatgtggttcttatactttctctaaaaaacttcttctagctatagttcctgagacagatacctccactattttattcttttgtggcatatatgacagtttaaattattggggtgattattggcttatgtgtttattatctctttctttcccactagattgtatactccatagaggccacactactttattcactactctatacccagggtctagtttagtgcctgacacacagtcaacacttaataagtatttgtcagatgtataagacaaacatgagttcaaaaatatgagcagtaaatttagagcagtagctttcaatcaagagactataaaagtaggcagttaacagctacccctaaaaagtgttttcatttgaactctgtggaagccttgatgatgtagaaaatcttttattgtaaattctgttcaatcaaaggcaaggcagaaaaacttcaaaagcaattctaggtaggatgaaggtatagtacctagaaaaagcaatggaatcacaacaacagcaaccactttcaattagaagttttgagtttgaattaaagcttactaggtatgtgtcctaggtaaacttacataaccatctctaatattcagattaatcatatttaaaatgagggggattttatataatataaaatttttatattatataaaattttatgtttttatgatgacttaatgagattatatgtatacaagtagctattagcattatctatggcatttaggagaaggggctcactattgattagttcctttaccttggccagccagcgtctgcaacaagattgagctaaaacttcatcaagtaaccaggataatacattttaggtaggaaaacatagatgaaataagggcttaaatgcagagaaaagtaagttggtgttagggttaatacataaaaaaaaatgtgtaagacagagtagcgagaatttcacagcagttagaaatggaaaaagatttcaacatgatacaaaaactgccaagaaatctattagcttttcccttaggtgacgcagtcttcccctcatataaataaaataattgctactattatagttggagaaaaatcaactgaaatgtacattaaacacgtattagagatttaacattcttcacatcatttcacatgctgaaaactcaacctttgtaaatatagccatgaaccttattatttactataataaagtaacagcatatccttttctatgtactacttgcagaagtataaaaggcaaatgtgttcttgctctttaggtgcaattacaaggcagcagaatgtagttaggctaattttttgcattttgtgctcatcagacagtggctaccaaccctgcaagaaaaaactggtaccaaaaatacttcatcggaaattctattttcatacttagttgctttcagtattcttactaatttggtcaaacttatgtcagctccctcattaaaattgttttctgtctaaatcgttatcttttctgtgtacgtatatgtgtgtatgtgtattatttggtcaatattcagacagaacaagtctgagatgcaccgcataacaaaagtaatcaccccatccccatacttctcagggaatatctacctggtaccaataagctcatcaagagttcatctgaattcatagcctttgtcaatcagaggtgataaactgtgattttagtagtctatgttccctgcaagaccatcgtcttcatgagggctagaatctggtttattttctttcttttttgtcatcaccacctagttcaggacaaagcacacaatatacaaccattggatatttcattcatttattctaaaatgtttattgagtacttactatgtgacaggcattgttccaagtggtggtgatttaggagtgaacaaaatagatggaaatttctgatctcatggagattatatatatttgttgtggatgtctgataataaatatatagaatgacagacaattatctgcgctaaggaattaaaataaagcagggaaagggaaaagtaaatgatgggattgggagttggggttgaaattttagatagggggaccagcaaagaaattatggaaagatcacattcaagtgaagacccaaaagaaatgaaggagggagttagccagaaatgccttggagaaaaggcaaaggaataggaaagagtttcctttaaaatgccaggctatattcagatagaaatgtttctattaaaatataaaggtatacgaaaggcattcaagccaaagaaataggaaagacttttctttaaaatgtcaggctatattcacacagaaatgtttctattaaaatataaaggtcctatagaaacatttctgtacgaatatataaacatcaaatacataaaagttttaaaatgtttcataagaaaggaacttagaaatcaagaagatagagctagggtatttggcattactatgattctaccacaaccctcccaggggaattatccagctcagtaataacctgagaaatttaggggtacaaataaagtttgcaataactgtaatcactgagaatggcaacctcctaatagatctggaatacctagaagaaacaaatccacttttgcaggataccttcaacaactcaggtcatgtgggagtctcacagaaaaagcaaacaccaatgaaaaagagctcatatatcaaaaatatcaaatccgaagaaaggttcatccataaatgagtcagcagatgaaaaactttaaatgaaatgtacgcattaagttcaaaatagggcacaatcttagggaactaatctgagggccaaaataaaaaaagaaagaaactatgaaaaaggcagatttgataaatatacagagatttatagaaataaaattgtcattaaaattaatatctgaagtgagaatttatcatattaaatggagctaaagggaggattactgaactgaaaaataattccaaggaatttacctaccataaaacagagatagaagatattttttaaaaagattaggagatataaatgacaaaataaaaaactctaacatatctaataagtatttaagaatgaaaaaaaataaagacaaaaatgcaatatctgaaatgatgatgaatcttttccaaaactgataaaacctcagaaaactgtaaaacagcatcaggtaggtccttcagggaatatttcagaaaaaggaatttttatcacaggagatgacagctccatgcatgttattacgccagaagaccttccagtgggacaagatgtagaggtggaggacagtgatatggatgatcccgaccctgtgtagacctggctaatgtgtgcatttttgttagtttttagcaaagtttaaaaagttaaaaaaaattaaatggaaaaaatacagaataaagatgtaaagaaaaaatattttgtacagctatacaatttatgtgagctttaaactaagtgttattacaaaaaattcaaaaagttaaaaaatatgtttataaagtaaaacacttaacagtaagctagggttaatttattattgaagaaatatgaaacttttataaatttagtgtagcctaagtgtacagtgtttataaagtctacagtagcatacagtaatgtcctaggccttcacattcattaaccactcactcactaactttctcagagcaacttccagtcttgcaagctccattcacggtattaattataacttataagcaaaagactataccatacagcatacgtgtacaataggccataccatctacgtttatctaagtacactctatgatgctcacacaatgatgaaatcacctaacaatgcatttctcagaatgtatccctgtcattacgagatgcatgactatatatcaaaactcatgcaatgcagctaaacagtcttagggagcaaagtacaactttaagttaatatgctaaaaagaaaagacaagactaaaattatcaagacattagaaaagttacaaaaaagtaaaaccaaaaaatgtaaaagctgaaacgtaacaataatactgagcataagggaaatgaaaaacaaaaatgtaaagacagtcaacaaaattaagtgttgctttttttaaatgactaataaagtagaaaaatctctgggaatttttattataaaaaagaagatagaaataaaattaaaaagaaaaaacaaatctatttggacatttaagtgattactgaatactatgaaatactttatgctaatttgacttaaatgttcaagttattttacaagtgaaataatatgaacaattttgtagaaaaatataacttgcctaagaagaactagaaactctgattcgacaattataaagatatcacatatgtggttagaaatttatataaacatacacacacacatgcacgcgtgcacacacacacacacacacacacacattaccaggcccaaatatatttaaatataaaatttaataaacctttaaaaatctgttgaggtctatgtgataaaaattggaccatagaaaacaggaaagcacctcaactcttgtataaggcccttgaacactgatatcaaacccagataaaggtattatgagaaagaaaaattatttacaatggtgaggatttagaagaggtacaagctagccaaaagacactcagaaaaagaaaagtaacaatagctattatttatttagctactactaagtgtttgataagagttttgcatatattatttaatctgtatatcagccatataagtggttttattttcattattatcacaattgtataaataaaatgatgctcaaaaaaaataaatgggctcaaagtcataaaattaataagtagcagcagttgatagagggagactctaaagaccatgtacttaaacactgccttgtactatttactcatctttcttaattatgttcacagaggacattatgctgtctccctaacacttcacccaattttaaataaagcataatttttggtttttagcagctttactatgatgttcccaagtgttgttttcttcacgtttattgtgtttagagttcactaagcttcatgtctttcacaaaatttgggaatttttaacctttcttcttaaagtctttaaatattttctctgtcctattcttgttcttcaataccctacatgagagaacaggaggtccctcagacatatacccccacagcaataaaaattttctagttatcccaaaaaaaaaagtgccctagttgaaactttggggctcaagtagggggttgtgaacactagtgacacccaagacctaagaaggccattttgagagggtagaatcaagcccacatgacagacttgccaatgatggtcccagcttcagacatggaaatagctccaacatcctgtatcaaaaacatcgacaaaggggcctggaagaagtcatgcacactaatgcctcaggtgacagtcatttgtcttggctgaggatcctaaaagggagctcccacttagctccagttcctcttggctgctctctcagagcagtcctgccagcacagggaaaaagaactcaaaataatgattttcaataagtccaatgagatgtagaaaacacaaataaaccacaaaatataattaggaaaataattcattaaaaaattagtttagtttaaatattatattccataaaaaaaggaccaaacagataccctatagctgaaaagtatgaagacagaagtgaaaaattcaatacagggcttcaacagcagactcaatcatacagaaaaagaattgatgaacatgatgacaggtaatttgaaattacccacctagaggaacaacaagaaaaagactgaaaaagcatgatgaaagtatgaggaacctatgggacaataccaagtgtacaaaaatatgaattaggaattcccagagaagacagacagagtaagaggacaaaaactaatataaagaaatactagcagaaaagttcccaaatcctgggaggcatatggacattcagattcaagcagcataaaggcttccaagagagatcccaaacaggaatgctctaagacatattataaccaaattgtcaaaagtgaaagacaaagagagatcttgaaagtagtgaaagaaaagagccttgttccatataagtgaacatccaaaagacaatcagtagatttctcaagaaaaaccttgtaaaccaggagggaatggaataatagattcaaagtgctaaaagaaaaaaaaaaaaaaacctgccaaataaaacagtatatccacaaaagctgtccttcaaaaatgaaggagggataataacataaccagacaaaggaaaactgagggaggtcatcacaagacttagaagaaatgctaaagaaagctcttggagtggaaataaaaggatactagatgataaaataaaattatatgaaagaataaaacttactggtaaaaataaacatatagtcaaaatcagaatactctaatactgaaatggtaatacgcacatcactttttaatagggttatttgtctccttattatttgttattaggtatacttttaaactttttattttaatatttttggaacacagtaagtatatatatttatggggtacatgagatattttgatataggcacataatgcctaataatcacataaaggcaaatggagtatccatcacctcaagcatttatgctttgtgttacaaagaatccaactacactcttttagttattttaaaatatacaattaaattatttttgactagtcaccctgttgggtgatcaaatactagatcttactccttctttctagctatcgttttgtactcattaaccatccccacttccccggctcctactccccagttacccttcccaacctctggtaactgtcattctactctctatctccgtgagctcaattgttttaatttttagctcccagaaatatgtgacaacatgttaagtttgtctttctgtgcctcactgacacacaaaaaagaatgacagaacctcattcttttttaaggctgaatactactccattgcatatatgggccatattttctttatccattcttttgttaatggacacttaggttgctaccaaatcttagctattttaactagtgctgcaataaacatgaaagtgcatatatatcttcaatatactgatttcctttgttttgggtatatacctagcagtcagattgctggaccatatggtagatctgtttttagttttctgaagaacctccaggctgttctccatagtacttatacttatttacatttccgccaacagtgtacaaagattctcttttctccatatcctcaccaccacccattattgcttgtcttttggatgtaagtcattttaacgggagttagatgatatctcattgtagttttgatttgcatttctctgatgatcaatgatgttgagcactttttcatataccagtttgcgatttgtatgtcttcttgtgagaaaagtctattcaaatcttttccccattttttatttggattattggattattttgtatatagttgtctgaactccttatatattctggttgttaatcactgtcagatggacattttgcaaacactttctctcattctgtgggttgtctcttcactttgttgatggtttcctttgctgtgcagaagctttttagtttgatgtgatcccatatgtccatttttgctttggttgcttgtgcttatggggtattaagaaatatttgcccagtcaaatgtcctggaaagtttcctcagtgttttttttttcagtagtgtcatagtttgaggtattagacttaagtctttaattcatgttgatttcatttttgtatataatgagagagaagggtctagtttcagtcttctgcatgtgggtattcagttttcccagcaccatttattgaagagactgccctttccccaatgtatgttcttgccacctgtgttgaaaatgagttcactgtaaacgtatgaatttgcttctgggttctctattctgttccattgctatatacactgttggtatgccagtaccatgctcttttggttactatagccctgtagtataatttgaactcaggtgatattcctagttttgttctttttgctcaggatatctttggctattgtgggtcttttgtggtttcctataaattttataattgtgttttctatttctgtgaagaatgtaattggtattttgatagagattacattgaatctgtagactgccttgggtagtatgggcattttaacaatgttgatccttccaattcatgaacatggaatatctttccatttttttgtgtgtccctttcaatatcttgcaacaatcttttatagtttttattgtagagatctttctcttcttcagttatttcctaggtatttaattttatctgtagctattataaattgaattactttttaaatttctttttcagattattcaccattgacacataaaaatgtcactgacttttgtatgttgactttgtatcctgcaaatttactgaatttattgatcagttctaatagttttctggtgaagtcttcaaatataagatcatctcatctcccaacaaggaaaatttgacttattgctttccagtttggatgagcattatttctttctcttctctaattgtactactatgacttctagttttatgttgaataacagtgatgaaagtgagcatccttgtcatgttccagatcttagggtaaaggctttcagtttttccccactcagcatgatactagctgtgggtctgttgtatgtggcttttattatgttgagatatgttacttcgatatccagttttttgagggttttttttttatcatgaggggatactgaatcttaacaaatgtttttttccagcatcaactgaaataatcatatggttcttgtccttcattctgttgatatgtggtattatattgattgatttgcatgtgttgaataatcattgaggcctgggataaattccacttggtcatgatgatcctaatgtgttgttgaatttgggttactagtatttgcttatggatttttacatcaatgttcatcagggatattggcctgtggttttctttgttttcttttctttttttttttaaatgtgtctttggttttggtattaggatgatactggcctcacagaagatggacacattccctcctcttctatttttcagaatagtttgagtagaattggcattagttctttaaatgtttggtaaaattcagcagtaaagcgatcaggtcccagggtttcctttgctgaaggactttttattacagctaccatctcattacttattactggtctgttcaggtattggaattcatggttcaatcctggtaggttgtatatgtctaggaatttactcatttcttctaggttttccaatttatttacatgtattaatagttgcttatagtagcttctaatggtcttttgaatttctgtagtatcaattgtaaggtaacctttttcaattttgattttatttatttgggtcttctatctttttttctgtcaattttgtttatcttttcaaaatgtctgtcaattttgtttatcttttcaaaaaaccaacttttcatttcactgatcttttgtattattttcttcatttcaactgcatttatttctgcactgatctttattatttatttaattctaccgattttgggtttggtttactcttgcttctctagttctctaagatgcattgttggtttttttattgaaagtttttctactttcttgatgtaggcacttgtcactacaaatttccctcttagttttgatatgttctgtttccattatcatttatttcaaaaaacttttaaaatttccttcataatttcttcattgaccaactgatcactcaggagtacactgtttaatttccatgtgtctgtatagtttccacaattcttcattattaatttctagttttattccatggtgatcagagaagatatttgatattatttcaaatttttgaatattttaaagcttgttttgtagtcttaggtatccttgagaatgatccatatgctgatgacaaaaatgcgtattttgcagccgttggatgaaatgttatgtaaatatgtattaggttcattcagtctatggtgcagattaagtccaatgtttctttgctgattttctgtatggatgatctgttcattgctgaaagtgggatgttgatgtcttcagctattactgtactggggtctatctctctgttaagctctgataatatttgctttatatatctgggtgctccagtgttgggtgtatatttatttacagttgttatatcctcttgctaaactgacccctttataattacatagtgaccttctttatctcttcttgtagtttttgtcttgaaatctgtattgtatgatatcagtatatttcaagtatacttccaaatatgattacagtattataatgttgtttttctatgtacatattacgtacataccagtagtattatgtactatgtaatagtaataatatttttactgttactgcaagttttgtaccttcagatgatttcttattgctcattaacatccctttctttctaattgaagtactccatttagcatttcctgtagaacaggtctgatattgatgaaatccctcagcttttatttgtctgggaaagtctttatttctccctcatgtttgaaggacatttcaccaggtatactattatagggtaagagtttattccttcagcactttaaatatgtcatgctactttttcctgggctgtaaggtttccactgaagagtctgatgccagatgctctgttgtatgttatttgtttcttttctctttctacttttagaatccttttccttatatttgaccttttgggaatttgactattaaatgctttgagatagtcttctttaggttaaatctgcttggtgttctttaaccttcttgtgcttgaataattatatctttctctaggcttgtgaagttctctaataccgtcctcagaacaaactttctacctctacctctctctttacctcacttttaagaccaataactgttgccctgttgagtatcttgtaggcatgcttcattcttttttattctgtccttttgtctcctaaatatgttttcaaacagtccttcttcaagctcactaattctttcttctgtttgatcaattctcccgttaagaggctgctgcattcttcagggtgtcaactgcatttttcacctccagaatttctgtttgattcttaaaaattgtgtcaatctatttgttaaatttgtctgataggattctgaattccttctctatgctatcttgaattttattgagtttcctcaataattctgtctaaaaggtcacgttatctctgtgtttctgagattgatccttggtgccttatttagattgcttgatgaggtcatgtcttcctggatggtcttgatgcttgtggatgtctgttaatgtctacacagtgaagaagtaggtatttattgtagtcttggcagtctggacttgtttgtacccacccttcttggggaagcattctaggtattcaaagggacttgtttattgtgactaaatttttggtcaatgcagctgtgtctacattgggggcactccagggtcagttacactgaggctcttacagactcatagaattaccatattggtggtcttgtacaagatctggaagaattctctggattactaggcagagacttttgttctcttccattactttctcccaaacagagtctctctgtgtgagtgtgcttagctgcctggtgctgggctgggagagacataatacaagttcccctgtggccatcaccactgagactgtgctgggtctgacctgaggccagcacagcactgggtcttgcagaaggcccactataaccactatttggctgctgcctacattcactcaaggccctggggttctacaattatcagttaccaacaccagccacatctgtgtcctttttttcatggcaccgaatgcccccggccccagatggttccagagaggccctctaagatccagggcctggagtaagaaaccttaagaatctacctggtgctccattctactgcagctgagctggcacgcaagccacaagacaagtcttttccacaagcacagaagtctcttctcttggacaccactgccacaggcccatggggagtactaacaagctactgtcaatgttcattcaagacccaaaggttcttcagtcagcttgtggtgaatgctgccaggcctgggactcatccttccatgtggtgagctcccctctagcctagggaaactccccaaatgccattcaagaaccaagtcctggattcaggaaccccaagagcccacttcctgctctacaacactatggccaagctagcatctaagctgcaagacaaagtccccttttctctcccatctgtttttctcaagcagaagtagtctctccctgtagccaccacagctgggaatgttctggatcacacctgaagccagcatgtttcagagtctcactcaatgcccatgacatgtactgcctggatattgctgctgattaggaaaggcccaaaggctctttagtcagcaggtgatgaatcctgccagggctgggtccttctcttcaaggcagcacattcccttctagcccagagtatatctagaaatgttatctggaagctagtgcctaaagtgggtgcttcaagactctacttggtgccctatcctactgtggctgagtgggatccaagttgcaagacaaagtcctgtttactcttcactcctctcctcaagtggaataaaggagtctctttcagagctaccaattgcattgcttggtgtcagaggaggggtggcagaagccctcccttggccaccctgtctggtgtctcactaggtcatatgacccctgcatccactggctccaagcctagcagagcactaggacttgcctaggagttgcagtccttgtggctcagactgccttaaagtttatttaggaccccagagaattttagcccatagtggtgaagtttgttgatacttgagttccaaccactgggatggacaatttctctcttgtaaatcccttttaagcctaatataaaagataaaagacaaaaaatatcaaaaacaactatagctagaatatttgttaatggatacacaatataaaaaggtataaaatgttatatcaataaagtgggggcctgggggaaaagcaagatacagagtttttatatgcaatggaaattaagttgttatcagtttaaatttgatggttgtcattacaaggtgtgttatatatgcctcaaggtgaccacaggaaaaaacctctagtagacacaaaaaatagagacatgaatcaaagcaaaaattgaataaaatacaaaagaagacagcaagattggaagaaagaaacaaaagaactacaaaacaggccaggcatggtggctcatgcctgtaatcccagcactttgggaggccaaggggagtgaatcatgaggtcaggagttcgagaccatcctggccaagttcgtgaaaccccgtctctactaaaaatacaaaattagccgggtgcggtggcaggtacctgcaatcccagctactcgggaggctgaggcaggagaatcacttgaacccgggaggcagagtttgcagtgagccaagattgtaccactgcactctagcctgggtgacagagcaagactccatctcaaaaaaaaaaaagaactacaaaacagtcagtaaacaattaacaaatggcaatagtaagtccttatttgtcaataattactttaaatgtaaatggattaaattctccaatcaaaatacaaagagtggctcaacagaaaacaaatatgtaaaatccaacaatatgctgcctataagaggctcactttagctgaaaggatacagagccaaaaagtgaagacatgagaaaagatattccattcaaatgataaccaaaagagaataggagtggttatagttatatcagacaaaatagactatcagtcaaaatctatcagaagacacaaagaaggtcattaaatgataataaagtggtcaattcattaagaggatataaaaaattgcacatatacatgcactcaacattagagaatctaaatatataaattaaatgttaacagaacagaagggaaaaatagacaccagtataataatagtaaaagatttcaatattccactttcaaaaatggatagatcatatagacagcaaatcaccagggaaacagtggtctttaaaagtactacagaccaaatagacctacagacatatatagaacattctatccaacagcagtagaatatacatttttctcaagtgcacatggaacagtctccaaatagatcagatgttgggccacagaacaaatcttaacaaatttagaaaaaactaaaattatctcaagtatcttttctgactacattataaaattagaaatcaatcaaaggagaaattaaaaatgaaaaaataaaagtggaaaaatcacaaacatgtggcaattaaataatacacttcttaacagccaatgtgtaaaagaagaaatcaaaaccaaaatcttgcatatctttaaacaaatgaaaatgggcacacaacaagagggaaggacataacaatgaatgcctacattaataaaagaagaaaaatctcaaacaacttaacttcacacctcaaaaaattaaaaaaagaacaaagtgcacaaagtcagcagtaataaggatatattaaaaattagaccagaaataaatgaaatagaaaatagaaaaataatagaaaagatcagtaaacctaagagttcgttttttgaagacagataaatctttagctagattacccaaggaaaaaaagaaagaagactcgaatttaaaattttgtaatggaaaatggacaattaaaatgatagaacagaaacacacaggattataaaaagactacattaaacaattacattccaacagattagataacttagtaaaaaataagttcctagaaacatataagatgcaaagactgcatcataaataataaaattcggaacagattaatagcaagtaaggagattgaatcagtaataaaaaattctcccatcaaagaaaagcccaggactagatgtcttttattttttgagacaaagtcttgctctgtcacccaggctgcagtgcaatggtgtgaccttggctcactgcaacctccatctcctgagttcaagtgattctcctgcttcagcttcccaagtagctgggattacaggcacccaccactacacccagctagtttttgtatttttagtagagatggggtttcactgtgttggccaggctggtctcaacctccagaattcaagtgatctgcatgtctcagcctcccaaattgctgggattacaggtgtgagccaccgtgcctggcaaaagaactagatgtcttgatgagcggattctaccaagctttaaaaaattaatgcccatccctctcaaacagttccaaaatgtttacaagaatgacacacttcctaactcatttcaaggccagcattgccctcataccaaagctggataagagtgctttatggatatacaccatcagcaagctatcgcaaggacaaaaaaccaaacaccgcatgtcctcactcataggtgggaattgaacaatgagaacacttggacacaggaaggggaacatcacacaccagagcctgttttggggtggggggaggggggagggatagcattaggagatatacctaatgtaaatgatgagttaatgggtgcagcacaccaacatggcacatgcatgcatatgtaacaaacctgcacgttgtgcacatgtaccctagaacttaaagtataataaatatacacatatatatatataaagagtgctacaagaaaagaaaattacagagcaatatcttagatgaatatagatacaaaagtcttcaacaaagtaccaccaaaccaaattcaacagcacattaaaaggatcatacaccatgatcaggtgggatttatctctgggatgcaaggatggttcaacatacacaaatcaataaatgtgatacatcacattaacacaatgaaggataacagtgcgggaaaagcacctgacaaaaatcaatgctttcttgataaaaagcctcaacaaatttggtacagaaggaacgtacctcaacataataaagatcaaatatggcaatcccatagaaaacatcatactcagtggtgaaaagctgaaagcatttcctctaagattaggaatgaaaaagcatactcactctcactatttctattaaacatagtattggaattcttagccagagcaattaggcaagaaaaaaattggaaaggaagaagttaaatggtctctgtttatagatgacataatcttatatgtagaaaaaccctgaagactgcagcaaaaaaagaaaaaaaaacctgttgaaacgatatatgaacccaatagtttcaggatacaatgtaacatacaaaaattagttgcagttccctacattaataaagaactctctaagaaattaagaaaaagatccatcttagtctgtgggcattgcttattacctaaggctgggtaatttataaagagaaaaagtttttttggctcatggcttttccggatgtacaagaagcatggcaccagctcctggtgagagctcaggctgcttccactcatggcagaaggtaaagtgaagccagtgtgtggagattacaaggcaagagagaaagaagagagagctgccaggctctttataacaatcggctctcatgggaaccaatagagaaagaaatcactcaatacatcaagacatcaagaaggacatcaaaccacttatgaggaaactacccccacgatcaaacacctctcattaggcctgatagctaacattgggatcaaatttcaacatgaggtttgtggggacagatatccaaattataaaacgattccacttacaatagtatcaaatacaataacatactaagaaataaatttaaccaagttgatgaagaattggtacactgaaaactcttagacactgatgaaagaaactgaagacaaaaacaagtgtaaaaatattgcacgttcgtgaattgaaagaattgctatttttaaaatgcccatgctacctaaagcattttcagattcaatgcaatctatcaatattataatgatattttttacagaaatagacaaaacaatcctgaaatttgtttggaaccacaaaagatcacagatagccatagcaatcttgaaaaggaacaaagctggaggcatcacactctgtgatttcaatttgtcttacgaagctacagtaatcaaaatagtttggtaccagcataaaaacagacacttaggtcaatggaatagaattgagagcccagaaataaatgcacacttgtatggttaactaatctttggcaagggcaccaactatacacaataaggaaaggaaattctcttcaataagtggttttggggaaactggatactcaaatgcaaaagaataagactggatccttgtcttgcactgtacacaaaaattaactcaaaatgaattaaagatttaaatttttaatttaaaaatgtaagatccaaaactgtaaaacaaagctccttgacattggtcttggcaaagagtttttggatattgacacgaaaagcacaggtaacaaaagcaaaaataaaaaaaagtagaactacaccaaactaaaaacctttttcacagcaaaggaaacaaaaactgagaaggcaacctactgaatgggagaaaacatttgcaactatatatctgatgaagggttgatattcagaatgtatgtagaactcacacaactcaatggcaaaaaaaaataataacaataactcaatttaaaaataggaaaaaggcctgaatagacatttttccaaagaaggcatacaaatgggcaagaagtatattaaaaagtgctcaacatcaataatcatcagggaaatgcacatcaaaactacagtgagatatcacctcatgcctgtcagaagggctaagagataaatatctgcaagaatgtggagaaacgaaaacacttgtccactgtaggtgggaatgtaaattggtatagccattatggaaaacagtatggagtttcctaaaaaaatttaaaatagaataattatatgatccagcaagcccacttctgggtttatatccaaaggaaatgaaatcagtatctttaagagatatctgtaccctcataattattgcagcattattcataatacccaaaagatggaaactacctaagtatccatcaatgggtaaagcggataaatgaataaagaaaatgtggtacatatacacaatgaaatattattttgccataaaaataatcaaacctgtcattttcaacaacatgaatgaatctgtaagacattatactaagtaaaataagcaagatatagaaagacaaatagtctgtgatctcacttacatgaaatcttataaaaaggtgaatctcattgcaacagaaagactgatgattgccaggggatggtggtggagaaaataaggagatgttgattaaagggtacaacatttcagttataagttgaacaagttccagggatctaatgtacagaatgggtggtgaagaatgtgtgaattaacttgattgtgataatcactgagaaatgtatgcataaaacaatcacaatgcacactttcactatatacaatctttgtcaattaaatatttttaaataaaaaataaataaaattgtacttccggtttttgagatactgcttattttttatccactcttttttctcactcctttttagattagataatttctattgatctatctttaagttcaatgacttttccttcaacccctcctccattatactgttaatcctactaatttatttatttaatataatacatttctctgttttaaaattcccatttggttcttctttttttttttttttttttttttagatgaagtcttgctctgtcgccaggatggagtgcagtggcgcaatctcggctcactgcaacctctgcctcctgggttcaagcaattctcctgcctcagcctccctagtagctggaattacaggcacatgccaccacacccagctaatttttgtatttttagtagagatggggtttcaccacgttagccaggatggtctcgatctcttgaccctgtgatccgccccctcagcctcccaaagtgctgagattacaggtgtgagccaccgcacctggccaatttggttcttttaataatttcttatttctctgctgagatttcctatctttttgttcatttcaaccatattccctttcatctcttaaagcgcagttttaatacctgctttaatttttttgcctagtaattccaacatgtgggtgattttaagattgtcatctgttgattttctttatccttaagaaagggtaacattttactgggttgaagtaattatggggtttttatttgtttggttgtttgtttttgttttgttttgtcttgagacggagtcttgctctgttgccaggctggagtgcagtggcacgatcttggttcactgcaacctctgcctcctgggttcacacaattctcctgcctcagcctcccgagcagctgggactacaggcgcccgccaccacacctggctaaatttttgtatttttagtagagacggggtttcaccatgttagccaggatgatctcaatctcccgacctcgtgatctgcccaccttggcctcccaaagtgctgggattacaggtgtgagccactgtgcctggccaattatgggttttaacttagacatcgtcaatgttaattgtggatactccagacttggagtccttaacttggacaatgtgttacattgagccaaagagtgctaatatctttgttctcatgggacattaatttggctaatctcatattgaaaaatttgtgctttttggatctcagtgtggactgatttcagtctgccctgtgcatgtgcagttcaggggtcagacaaagacttaagacagaatttatacacacaatatcccatctctgtctctttactttcctatgtttttcctcattctctgacatccccgttccttcccagagttcctacagcctacagagaaagcaagggctttctcttggagttaaattgtcccatgttgccactgcaattggagatgccctcagaaaaagcctcagaaatgtgaaactcacttcatctcatgacatttgcttaatacaaagtttgaacctcctctaatatttctctagtcttatccattctccaaaacctttacagagttgtattgtgttttgttatgctttgcttttatttttggtttttgtccagagtttatagctactatctgcaggctggttgtttttttggaagtttatttctccacacaagaagcaaaactcttgtattattactaatcctgagaacagaaggttacagagaaacagaaaacagaaggctttaaaaaagtaccaagagatacaaataaaaattgaataaaaaacaaacaaacaaaaaactagaaaaatgtctcctgcttctaggagagggctgaacaaaggcagatgaagaggcaataaagtaggtaataagtacatttacagaaatatatgccatcaaataggtaagaatgcaagtaaaatttatatataacaaatacccaaaagttttggaagcagaaaaaatgttagtcaatagttcatattgtctaacaatcaatctgtcacccaggctttgtcacccaggctggaatgcagtgacgtgatcatagctcactgaaatttcaaacactatcctcctgagtagctgggactacaggcatacaccaccacatctggctaattttctattttattttttgtagacatacggtctcactatgttgcccagactggtcttgaacttctgggggctcaatcaatcctccctgcttggcctcccaaagtgctgggattatagtgtgaaaggaaaataaatcttggggcccaaaatcactaagctaaagggaaaagtcaagctggggactgcttagggcaaacctgcttcccattctattcaaagtcatccctctgctcactaagataaatgcatatctcattgcctctttgtcaaggctaatcagaaactcaagaatgcaaccatttgtttctaatctaccaatggcctggaagccccctcccactttgagttgtcctgcttttgcttcaagttgtcctgcccttacgaaccgaaccaatgttcatcttacatatgttgattgatgtctcatgcctccctaaaatgtataaaaccaagttatgctccgactgtcttgggcacatgttatcaaaacctcctgagactgtgtcatgggcatgtgtccttaacgttgacaaaataaacttcctaaattgactgagacctgtctcagattttttagtttcacaacaggcatgagccaccatacctggcctcaaaagtttcaaaaccaacactcttcatcagatcccagaaccaaagaaggaaaaaacaattgaagaatttatgtccacagttatgccaagatttacactaatgcataccacatctcaaagattgaagaactctctcaagaactggcaataattaagtttccaaccaaattatattttctaaattaaaaataagcacacatccaagtgtaaaatttaaaaaaacctgaagctaaagcacattcaccttatagataaaaatatagtccatacctctctattttataaatgcattttcagacttgatgcattataggacatggtaacttcaaacagcaaggaaaaaactcttatttaaaactcagtaagaatataatctctgtaagaaaattatcattttaaataatttcattaaactgttttctcctttgatatacccctggatgtaacactattaggttatagtgaaaaacaccctcaattaactctcaaaaagtatggttccaccattaagctactatgagactttggacaggtcccttcacctatctaggcttcagtttactcatgtgaaatgtgaggctagaacatatggtttctgctttccaggtgtaaaattctataactacataactttatcccttcgtttcatgcagttttatctccgtcttccacttctgtgtcttcctggctggagtagctttatctgtcgtctgaggcatccggggcacaccccatcatttcaggcttagccgtttctaagtcgaaggctgcagtcactgagggcagcctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggaaagattcttgtttaatttctaaaaaataaatttggcaaattcctcagatctcaggcccaaagaaaatatttcaggagagatacattatgcctttcacgcaagtgcaaaaaaattaaaaatgtagactcccacacacaatctcaagcaaatcatcaactgacatctgatgttgtcttacctacagagttaagaagcttgtttacatctgtacttcaggtgagtgagataattttgtgaatggtaggttaaaagtaatttcaaatttgagaattaagcaatgagaaatgtgctgtaaatttcaagaaaaagatgctgcaatactgtttaggattctgagaactttagatctatcttcttataaaaacttccacttagaaacaaagaaataaacaaaaaccaggataaacaatacaatgctctttccaacttgctggaattacattcactcagataaacatttattaagcacttagttggtacaaggtgtactgtcctctgtgagacacacactcatagaaaagaattttgtatctgctttagtgagtttataatatgccagaataaatacatactaaaaggcatatatacataaataatataatgcattgcaggaagaggtaagtactatgatagagggacacagaaagtcctgtgcctcaggccttgctccctgcagggcactaagctatttcgaatcacactgcaggaggtggccaactacacagtatgcagtgcatcagtgctatccagggaagaaaagactactacatggttaagagagcctgaaaaaacagaagcagagaggtggacctagaaaactagcagtcggttgaaggtcaatatgttcctacctggaaaatagggtccaactactgggcagaaggccaggacccaagggtgattctgtgcaactgggggaggtgagaaaggagagaaaggaagtgagtattctgctgtgggaagaagggaattccaagatgacaacacagcaagagcttaactatagatgaaggaattctgaatttcttctagtttcccatctcatgatcatgtcaatataaaaggaaattactataaaatgtaataatttctaccagtctacagattctggcaggctaaattaaacctgaagataaggacaaaattacattccagttcctacttacaacttctatcacataaagaggtacttacatagttcatatgtgcaaactgagttgcatgctttctaaatcgttttatttaattgtgaaatgtttggaattgggtgtcactggtcttcattttgttttgaaaaggcaatataagtgaattaatctatcatcaggctaataacaagaataagtattttaactccttcctttgaaatgaaaagacaaattctttagccaagagcttccaagtttaatttacgattcacaaaattctacaaacataaattatatagtagaagtttcccttattcttacttgaatataactctaatcatttgaatatcagttttaacaaaatgaataagagtacaacagagttcagatgaagctcgtttcttgccaaaatccatatgaatgccaaataccttccaagcacaaataaatcctgccttccatttaaacaaacaaacaaacaaacaacaaacaaaacaccacattgcctaagattgggcaatcactactaagtgactactaagtagtgagtaagagctaagggaaacggagcgaactttaggtcaccagggcacggtacactgaaaaacatgtgctgcgcttcttcagaaacaagctacaacagcagaaagacgaggtaccttatatcttgtttataaatcttactttataaaggagaaaaaaatgaaaaaagggaaataatattcccttatatcctattttgtgctaggcacttagacaatgttttattatttaattgaaacttgagttcaatcggtagcaggagcggcgagcggaacccagagagccctgagcagccccaccaccgcccccggcctagttacagtcaccccagaaggagccacaaccctgcagccagcaggtcaccatcacagcaaccacaaccctgagcaaagacgccaaggcagccaaccccaagccggcaccacctgcagcggcgcagggagcagtggcaagggcgacctcacaggcggcgcctgctgatggggataagatcaccgcaaggaagattttgggaacagtaaaatggttcaatgtaagaaataaatggtttcatctatgcgaatggcaccaaggaagatgcagttgtacagcagaataccatacagaagagtaaccccaggaagtaccttagcagtgtaggacacggagagactgtggagtttgatgatgttgcagcagaaaagggtggggaggcagtaaatgttacaggcccctgtagagtccagttgatagcagtaagtatgcagctgaccttaaccatcattgacgctatccatgtggtcctcaggcaattaccagtagaattaccagaatagtgagagtggagaaaagaacgaaggacgggagagtgctcccttaggctcggcccaacaatgccggccctgctgcaggcgaaggttcctgccttactacaggcagagaccctacggaaattgaccaccatattctaaccctccttgcagggagcagcgacggagggtgctaacaactggggtgcaggagcacaaggtaggccagtgaggcaggatatttgtatggtttatagaccacgattcctcagggaacctcatcgccaaagccagcctagagaggacggcagtgaagagagtaaagaaaatcaagatgagacccaatatcagcagcgacctcaacatcggtgctgctaaaaccccaattatctatgtagactcccagaaaaccctaaaccacaacatggcaaagagacaacagcagccagtccaccagtcaagaattctgcacccgaggcagaagaaggttgagtaaatgccggtttaccatctccaccatcatccagtttaatcatccaacaagaagaaatgaatatgaaattacagcaatgagaaatgcaggaaagaaatgctgaagaccttaagtgcttgctttttgcccattgatcagaaaccagaactacctgcattatctacgaagcatggggtttttaaaattatttttacctacagacatgtctttttggtaataacaaaggtttttattgttgttgtttttgtgtgttttttttttagtttggtttttctcaacatgcctttaaaagcttttaaattggttcatatgtcaagttgagatttttaagcacttcacttttaatttgtaataaaagtttacaacttgattttttcaaaaatgtcaaccaactgcaagcacccattgaaagtcttaaataatacaaaaactttaaattaaatcaaatgggtattaacaccatataatacaaaaaagaagtgaggttcgaaaatccttatgcttttgtgatgccacacgtcacctaactggtagcacaacttgattgcaatctgactctgaagcttttcttcattcctagacatcctatttttgttgaagtcctagattttaaaagtataatttttttaggaataaagatctggtaggcaggaaattctgctgaagctgtttctgggcaacttgactttgccagggcctttgcactgattgtgttaatggccacctcctcttcagatgtagggttatggatcacctgtaaccacctgtaacctgtacagcaagctgaaggagtgtttgcctaatatccaatccacagaatttatttcaaaaatggtgagcctcactaaggtgatagcagtagcctgtccacaggctgatcaacaaaatcttgtctttgatccatggtttctgcttcttggagtctcccaaggtacattctgccactgctggacctagaatcatagtctcctttcctaccagccttctcaccctgccaaacttatcatatacaattgtttgacatcacagatattatcaatccctaggcctctctagctttctgctcttgcaatttcttttacattgtctttgtcacccagcacagagcccatacataagtcatcactctattttcttagaaatactttcagttcacttcttggttttcctatctcacttaccaagctgtcttagtacagatctaagatgagaattttagtacaaataatttattttggaaacaaccccatgaaacactggtaagggagaaaggatggaaggcagaaaagggaaataagatagaatgtttgcaaagataaccatcaatagttcctcaaagccttgctctagcatgctgctcttcccatcaagaggcagagtttgtttcccccactcttgaatctgcactgaccttgcaccctttttttgaacaatagattgcagcagaagtgatgctatgctagttctaagccaaggctgcaagagtcctggcagcctcttcttttgctttccttagatgcagataccatgtaaagacgctcagactagattagtgaatgatgagaagcaatggggagagacaggcccagacagaccccagccattctatacattgcactgaggcctaaaacccataagtaaagccatcatagtcattcctgacccagacaggcttccagtcaagtgcaactacatgagtgacccaagctattactaatctaagcctgggcaccccaaagatttgtaaaaaataacaaatctttgttgttttaagtccctgtatttgggggtagtttgttacacagccataaatgaaacagggacaaagccaaaaaagggtacaattattaaacaagttactgctatgggaaatgagtttagtccttctgggatactctggaaaacagtaaagaacatgcctcacagttatcccatgtgaagggtaaggatgatagtgtaatccacccacttgctaacagttatttgcttaagtctttttctagtgacagtaactatttggtactttaagcctgcccaacactgtgagccaaatctgctcagcagccacacacaaaaaatgccttcaggcagacagtcacagtatcaggaataagcagtcttctgtgacaagaggtgagtggtggaaggaaacaggaagagcgtcaacataggtgaaaacccaggcctagagcagtccagctatctgctttctccactcctagaactgcaacagctaaagtgggtcacatacactcacagattataaccactacacatctacagctcccaaacttagctgggtcccaaatgttacttaataatccttccaagtttccctaatcatctgtttactttagtatattttacatctatttcaaaacttcccacttttattaaatcttctattccacctacccctcccccttcggtatcagcaaagcaatatgctctctatcccaatgagaaaataaaggtcatcagatcaattttttgctacctccattgcactgcattcagaatcatccttccttccttccctactaataccacaggaaagggtcaaggtaaatgcagcattaatccagcacctctccatctctggaataccccaccttagaatacaagaacccattatgtacttgcccttttctgtctctcttaggtccctaatgcatgaatctcatcgagttatagatctgttgaaaccctacacctatggatctttgcaccaagcattgttcctactgcctaaaatgtaccttccccaactttccccatttctagactctgccctggcagagtcctcttcatcttttagacctccacttacctgcgacctcttcaggaaagccttctttactttgctgcccacgattcctcaaatctatgcttacctctgccacagcactttgctcttttctgaaatcgctcattcctttttctgatatccttttcctcctcctttacctcccactgaaaataagctcctccaaatcaggtatttgccttatatatttttgaaccatagtatctgtgcctagaacatagctgtggattaacaaatagcaccaaatttaaataaattaattaatcatctcttttccttaagttactttccagagtaactttagtggaagctgcaggcaagatttatgtgtactgtggcccttcctctttctatctttttttttctttttaacattctaagaggtatcatacaggtcatgataaactgagtctcttctaaatttgcatatagtgaaaaataacacgtcaaaatgcatttgcttagaagctcaggaatccattgttcagttaaaacttgttgccttgttataatgttatgacaaaataggcttccatactggcttttaacatataattgttaattatcatcacaaaagtttcaaaatttcttcagttttaaaaagattttcataagtaaaaatgcatacagtacttgtatactcacagtgagcttatttaataatatgtttgtagaatgtaaaatagctttctgttttatggtcagatttgataggcctatcaaaattggtttttatagatatgattgctactttcatcaaaaaatgaaccatcaactttaagagaaatgaaaaaatcaatttgggtcatggtaacttctaagccctactacctagtcctagaatttgttcttaatagaccagactgtctgcaaaatactttgaaacaaagaatgtgtactttgcctcctccctaccatgttcttggcaactagggaatatgggacattttaagtctttaagataaaattaatcacactgatttagaacaactaaaatcttgtcagagtaattcctaccttctcccttccccaccatgttacctttaggaagaggagacacacttgaggaagctcttcaaggctggtcttcagggaaataaagacattgaaattccactccaattattttttattacctgccaccttgaatccagaatatatgttacattatgaagtgtcgtattcttgactcaaaacatccttccaattaagattttcttttttaaaaaaaattaggttaaagcaaaaatgcagaaaagaagggtaaataagattagtaaaccatctgaaaattactgcattttgtaaactttggtaaaatgtatgaagaagcatgttttccagtctgctttctcggcctgtggatacctgggacataattcagtttgccatcccctgttcccagatcagctcagtctttgttcagctccatcttcaatctggcatataattacttcttcagctcctgtgctatttggttttaagcacctcttacccccaaggcctcatggctctaagggcttgttgaatttaaacaagcacatttaaatctttgtctttaaatgagtaaaataaaagtcttaacacctaacacagagtactcttctacactctaaatgtgcatgttataattgcctaccagatcataatgagcatctatccatcctcaaaatcagagaaaggggggctcattctagaggtaaatttacaataaatggctttattcttgattagctatgtgtgtttggggacacagagactggcacctgcataatttaaatacctgataggaatcagatgatcaggacaccttggaaataaaggtggaaaaacaatagtggaggaaacacaataatggaggaaatacagaagaaaaaaaacaagattgttaaaagaaattaataaaatacaacttaaggaattttaagcttcacctctcattggaaaaacactgcaaactcatacacacactgatgcatgcacacatgcatgcacgcacacatgcatgcgcacacacacgtatgcaatataattacagaaatgttaaaactgtctgtctttcctgagagtcaggagatgtggattctgccactactgctgctggcaaatcataaataccatccagggttttagtttagcctgagtaaatgagtaatcattacatttgttccacatacatactttactccaaacactggtagataagtattgaatgagaccctcattcaaatacacggtcaaaaatgccacaaaaagaagtattataattataactattaattataagtaaagttttttaatgaatggataaattagtaaaacaaattttaatagatataaatggaaaacaaagcatgtgcaatctcactagtgatgaaggtaatagaaattttaaaagtgagatactagtctttcacctatcagatcagttaaagtcaataaaagaaaaattcagtgttggaagaggcactgcagtgggagtgtacattagtaccattaagcactatgtatcaagggcctgaatcatgattatgtactgtgccagtttgggtcctcttgtgccaaggtgaattgggtatgtgagataattatttggggtagaatctatacatgataaaggggaagaggtgtaggtaaggagagcactcagactatgatgcaattctgacatctctgaaaggagaaaggcaaggaagcatttggtaggaagagatctgcatgcaggaaagtcctgagaaagtctcagccagggttggttccaagtctttgttattgtgaatagcgctgcaataaacgtatgtgtgcatgtgtctttatagcagaaggatttataatcctttgggtatatagccagtaatgggattgctgggtcaaatggtagttctggttctagatccttgaggaatcgccacactgtcttctacaatggttgaactaatttacactcccactaacagtgtaaaagcgttcttatttctccacatcctctccagcatctgttgttttctgactttttaatggtcgccattctaactggcttgagatggtttctcactgtggttttggtttgcatttctctaataaccagtgatgacgagctttttttcatatgtttgttggtgacataaatgtcttcttcttcttcttcttttttttttttagatggagtctcgctctgttgcccatgctggagtgccggggcgcaatctcggctcactgcaacctccggctcccgcgttcaagtgattctcctccctcagcttcccaagtagctgggactacaggcgcatcctaccacatcctgttaattttttgtatttttattagagacagagtttcaccatgttagccaggatggtctggacctcctgacctcgtgatcagcctgcgttggcctcccaaagtgctggaattacaggagtgagccactgcggccagccgtaaatgtcttcctttgagcagtgtctgttcatatccttcagccacgttttgatagggttgtttgttttcttcttgtaaatttgtttaagttcctggccgggcacggtggctcacgcctgtaatcccagaactttgggaggctgaggcgggtggatcacaaggtcaggagatcaagaccagcctggctaacacggtgaagccccatgtctactaaaaacacaaaaaaattggccggccgtggtggtgggcgcctgtagtctgggactacttgggaggctgaggcaggagaatggcgtggaggcaggagaatggcgtgaacccaggaggcggagcttgcagtgagccgagaacgtgccactacactccagcctgggcaacagagtgagactccatctcaaaaaaaataaaaataaaataaaatatttaagttccttatagattctggatattagccctttgtcagatggatagatggcaaaaattttctcccattctgtaagtcgcctgttcactctgatgataatttcttttgctgtgcagaaactctttagtttaattagatcccatttgtcattttggcttttgttgccattgcttttggtgttttagtcatgaagtctttgcccatgcctatgtcctgaatggtatcacctaggttttcttctagggtttttatggttttaggtcttacgtctaagtctttaatgcccatcaatgatagactggataaagaaaatgtgccacatatacaccatggaatactatgcagccataaaaaggatgagttcatctcctttgcagggacatggatgaagctggaaaccatcattctcagtgaactaacacaggaacagaaaaccaaacaccgcatgttcgcactcataagtgggagctgaacaatgagaacacatggacacagggaggggaacatcacacattggggcctgtcgggtggtggggaagtaggggagggatagcattaggagaaatacctaatgtagatgacaggttgatgggtgcagcaaaccaccatggcacatgtatacctatgtaacaaacctgcaaattctgcacacatatcccagaacttaaaagtataataaaaaaaaaattctagaaaaagaagttgcatctgtactgaacatgtacagagttttttccttctcattattccttaaaccatacaaaaaagaaagtctcagccatgttggtagggagtccctgaaccagagttacccattagaagaatctagtattgggcagaaatgtccccgttctggtattcctgacatgttcagtcactcggtggaagcagccccaaagaaggatggtttcagggtgaatgttgtggtggatccacaggtatagcagctggaggctgtcaattatctatgctctctacaaaagctcctcttgaaaacagagctgagaaagacacttgtatacatatgattttattcccgttctaggaatctatctcaaggaagcaatctaaataccaaaataataatgataaagagctttatgaacaaagatgctcatcgcagtcttttaaaaaataattgaaaggatagaaacaatttaaatgtccaagcataaggattgattaagcagctatagtatgtctactttaccaaaaatgctgtggctattacaatggaaaacttatattttaagtaaaattgaaaatagagataaaatatggtataacttttaaaattaaaagctttgaaaagatacatattttaagactggcagaaaataaaccaatatggtagtaataggaagtttttttgcatttttgaattttccaaattttctttattaaaatttatgacctttagctgagggaaggaagcattcaaaataaaaaggcaaaaaagcaaaatagttaaaatgatttagagtcgaagtaagcaggggaaatatgaagctatagaagagaaaacaaagaagacaataaaaatatctgaagaatactgtcttaataattctgggactaggtgtggtggctcactcctacaataccagcactttgggaggcccagccaggaggattactcgatgagcccagagttcaaggctgtagtgagtgattattgtgccgctgcactccaggctgggtgacacaccaagacccagtctctaaaaacaaattctggaaaacagcttcatggctccaacataacattgaacaaagccaaagatgggaaaggaaaagggaatgtttttattttcattgtagcattgggtttttaaatgaaaactgatgtttcatatgctcttctatgactattcagtataggtgtttcaccatcattgtaaggagtatcttctgtgtatgtaagtatgtgttcactagtgcattcattttttcaacatgtgattaaacagtttgagagtcaccatatgccaggtactgtgcaagcaaatcaaaggtcacagtgtaaaatgagaaagggtatgttttggccctctattctagaattgtttatagaaagtgcataatttaagcccatatgtcccatgtcctaaagatacctgtccattaaatacagtgcatttcattgccttttcagactctcttcactatgcacataagtgacaatgtaattgcaatttgattaattcatataaactaagaaaggaggaattattcattcatttctgatttttttttttttggaaagtatcccattcctactatagtttgccaaaccctctcagggtagacctctatttacttaaaagaactagtttcatagattgctgtcatgcaccctaattagacaaacgtgttttccaggtctatttgaaggacattctgatataatgcatacctatcttcttaatcttcttattcagcttatgcatatttcttttcctttaaaatccatcaataaatgatctgtgatctgtaagtaattaatttaatgattacatgaattaaaataatgcacattgctttaaaggagttagtattttcggtttatgttacaatattggccttgggtaaatatcatccattgcctgaatttcataatggttcaaggataaaccatttcctctttataattcagtaagtttgttccaaaggagcctattgctcctctactcaacaatgaaagaaatgcattcagggaccttaggttgcctattcttaataagatggaatcctttcccggtttgttaaattcactgaatttataactcattgttactgatgaaggaattaatccaagcccgttaccagattgatctcctaaaatccacagagcgaatttggtgtcatttttaaaaagaaataaaataacaaaaataaaaatacaaaggatgtcagtaagttacagacaggagggcatacctcatatttatcacctggaaaactagagaaaagtttcatcaaaactgtttcatgcatctgtgcagggctaaagtcatctgctaatcagcactaataatgatggggataacaataataatctgctacctttacataacagtttttaccttgggaaaagattttcacatactactcttcatttagttcttataatgactttgagaaactaacataaatgttttacaagtcccattttgtgaaagagaaaattagagtacaaagaagagactgacccaacaataacatttaactggagctagactcctacttcaggtttttaaaatgctttcaaatcaatagaattcatgatttgcaatgttttcctaaattctgttaaaacacacttaggaccgtaaattttcaccaaccataacagacacctggtaagcgggcatgtaataaacaattgagatgttagaaaaaaagatatgtctctgatgagcagggcaaaagtgaatgtaagtcaaaagatatctaaagactctatagcttctggaataataaattggtagttttctttatttttcatttgttgtttcagaaagtgtttaacttttgatactaccaccaatgtaaaatataatagattgttagtaacaataaatcaatctctacgttgtccaaataggtgtgtttacccaggtccacactgttcaagttttattaaaactgtttcgttttatccaggtttccagtattgcatctcctaagacaaacactgatatttatctgctgatgcttgttttactaaccaaatattacattacacatggtttatcacattacccagggaggtgacaatatttcaggaaaaaaattaacaaatcaaaataactttgaaaactgtttataccccatgtacaaaagtactgtctatgcctagttattcactactatcacaagatatacataaatcagagtttttaaataatactgacttccccttataaattcctttaccccttgtgaaaggaacctagcaccattatgacacagttaagcattagtcacagtttaataaataatttcgttatagcctcctagtctatcagtattatttggattctcagaatgcatgtaatcatgtaaattacaaaatttcctttgtatcagggataaccaactgtcttttataaataatgttatttttggtgatttttcaatatcagaacagtatagttttggctagagaaattactataagcattcaaataaagattaatcaatttatacaaggcaaataaactttttgtactcttaaatacttaaagaataatatatacattcaaatatttgtaagaaattcatatagaggggagtataaaacacatatggaaaaggaggtatgtctgcagaagttactttgtaaagaaacatagtgctcaactaccaccctccctcaaatatcatgtcaatcaaattagcatcataagaagaactccagttctactgtgatagagtagcttatatcaaatcaccccctcgttgagaaaaactattaaagatgaataaaatgaaattattttaaaaactgtttgaaggcaccaggcaccaaccaaagtaatttcaatttaaaactcaatagtctataaaggaagtaaacacgttaaagtaagccctatgttgtttattacttttcaaattcaaggcatttgctgtttcctaagtagaacagaatgcgagactgagcacaaagctccagattagaacattaagaagtcttgtaaagagaggagggcacaaataacactttggagctgtcagcacagccaagacatgaagaatcaagatcctggataaactgtaaatgcaatgaggtgaggcctgtattctttttccacttttaacccctaaaacatttccagttcctctttcttggagtgagaaaatcaaaagagaaacaagcagaaaacagcaacctaaatactaggacattaaaaagaatattcagtagtcttataccaacgaagcaaaaactggagtttagtgactacttgaaaagcactccaaaattttatttgaacctctaaatgactatttataaaactaagggaaaaccataactagagtagccatcacaaagatggaaacccaacttcaaattgtcttaatccctgataagattaagtaaattacctttattctaataatctgtgaggagaaaattaaatccccatggaaaaatataataccatacaaaacactctaaatttttaatatgaaaaaatcatcaagcatgctaggaagtagaatcaaagaaccaaaacaaagagaaaaaataatagacaaaaacataaattcaaaaatgatacagattaaagaattatcagatatagtcttttaaaaacagtgataaatatggtttcagaggtaaaggaaaagagtgagaataatcagagaactgggatttatattaaaaacccaaagattattctagaactaaaaataaaacaaaattaataactcaatcgcagccagttagacacaacagaagatccaagttgtgaacttgaaaataggttaatagaaaatatccagaataaaacaaagagagaaataaggatgataataaaagaagaagcattagagatatatagaacatggttaaaaaatgttttaacatacaaatatctctagtcccagaaggaaagggtaaggagaataggcagaagcaaaattcaaagcaataatggccaagaattttccaaaattggcaaaagcatcaagccacaaattcaagaatgtctaagaaccccaagcaggataaacacaaagaaaccaactacaaaaaaaaaaaaaaagcctgtttgtaaaactatttaaaaataaacaataatcaaaaaggcaatctcaaaatagccagaaaaataaaaatgcattactttgtaaggattagtaagtctgataactgattgctcatgaaaaacaattgaagccagagaacaaagccatgatatctttaaaatgcttttaaaaagtaactaccaacctaagaaacccaaacaacagcaaaaaactaaataacctgattaaaaaatgagtaaaagatctgaacacacatttctcagaagaagacataaaaatggtcaacagatatatgaaaaaatgctcaacgttactaatcattaaggaaaagcaaattagaaccacaatgagatcacctcacacctgttagaaaggctaccttcaaaaagttaaaagacagtaagggttggcaagaatttggagaaaatgaaactctcatacactgttggtaggaatgcaaattgggtacagccattatgaaaaacaatatgaagattcttcaaaaactacaaatataactaccatatgatccagtaatttgacttcaggatatatatcctgaggaactgacgttagtatgttgaagagatatctgctctcccacattcatcgtagcattattcacgatagctaagatacggaagcaacctaagtggcatcagcataaaaacagataaagaaaatgtgttaaatacacacaacagaataatattcagccttagaaaataaagaaatcctgtcatttacaacaacatacgtggacctggaagatactatgttatgtgaaataaggcagacacagaaagacaaatactgcatgatctcacttaagtgtgaaatccaaaaaggccatagatacagggagtaaaatggtggttactagaggctgagtgttggatggtgatgaagaaaggggagatgttattcaaaaagcacaaagtttcagctagacaagaggaataagttttagagatatactgcacagcatgatcactataatttataagagtgtattatatattttgaaactgctgaaagtatactttaaatgttcttaccataaaaacacgataattatttgaggtgatggatgctaattagcttgatttattaattctacaatgtaaacatatactgaacatcacactgtatctcataaatatatataattgtcaatcaaaagtaaaataaaaataaagcaaaacatatatatacacaaaaaagtaaataccaacgtagaattctctaaccaatgaaagtattcttttaaaaagtcaaaataagaatattttcagaaaaacaaaactgcggaaatatttcaccgaaagattcatactataaagaatactaataggtatctttcaagtaaaaggaaaagcatctcagacaatgatagagaaatgcaaaaaataaagtacacagacaagattagtatgcgtataagtatagaaaaataataaaaataatgttttaggaattagagcacttgaagaattataattcaggacaatgataagacaaaaaatgagagagggacaaatataattattcattgaaaagagataaaaggtgtaagttacagtagagctcattagggtaaccactaagaaaaattaaaaatacgtaattagcaagttaaaagaggggcaaatgaaataacaaggttgattaataaaaaaagttaagacagaagaaatgggaaacataaaattggtagaaaaaatagaaaagtacagtaagatgatagaattaaatcaacaaatattagcaagtgcagttaatgtaaatttaaaaagttgcattgaaatacaatgtcagactttgaattaaaaatcaccattaataatatgctatttgcaggacacataccttaaaagtaagtatacagaaaatgtgaaaggaaaagtgctaaaaaaaatttaccaaacaccaacgaaaagaaggctaatatcactatacattataatatcagtctaagtagaatgaaaagaaatagtacaagaagagcattaaataatactagttaatctactaggaagatatcacagttccaaatttgtacaaaccaataacataagcttaaaatgtacaaattgaccaaactaaaaggtgaaataaacaaatacacaatcaagttagaaaattttgacatatttctctcagtaaatgatagaacttggtaaaaagttggtagataaataaaagttttgaacaccaagatttagcaaatttgatctaatttatatgtacagaatcctgcacccaatagcaacaaagtacacatatttgcaggtgcacatagagcatgcaccaaaagtatccttaaactgagtcatatagcaagcctcaataaattttcaaagtatttatatcatatagaatatcttctctgaccgtaattgaattaagctcaaaattaataacaaataagtattataaaatacatcaaatactttcaaataaagcaatagataaacttgataaaagtcaaaaattggggtcttttggtaaagaaagacaaatataagcagtagtcttctagaaacacaaatttcaaagatgaaaaaggacaaataaccttaacaggaatgaaaaaatggagtattgttacagatgctacagacatagtacaaagataataagatctggtgaacaagtttacatcaataaacttgaaaaaattgatgaaacatataaatcccctgaaaaacacatattaccaaaatggacacaagaagaaatggaaatccttcatagtactacgtcttttaaaagacatgaatatttgatttggaaaactcttctggacactggtctagagaaagaattcattaataagacaccaaaagcacaagaaaccaaaacaaaaacagacaaatggtacttaattaaactaaaaagcttctgcccagaaatagaaataatcaagagtgatcagatgacctgcagaatgggagaaaatatgtacaaactatcaatcagacagaggactaacatctagaacttacaaggaactcaaactaaataacaacgacaaaacaaataatcctatcaaaacgtgggcaaaagacatgaatagccatttttcaaaagaagacatacaaatggccaagaaacatataaaaaaaaaagctcaacatcactaatcaaagaaatgtaaattaaaatcacgatgagagatcatctcagactactcagaacagctattacttaaaaagaccaaaaacagcagatcttggcaagcaattgcagaaaaggaaacgcttatacactgttggtgggaatgtaaattactacaatcactatagaaaacaatatggagatttctcaaagaaccaaaaatagatctactatttaacccaacaatcccaccattgggtatatacccccaaaaagaaattattataccaaaaatatacttacactcatatgtttatcacagctctagtcacaatagcaaagatatggagccaacttaaatgtccatcaatggatgattggattaaaaatgtgaaatatatatgtaataggatactatccagctataaaaaagaatggaatcacatcttttgcagcaataagaatggaagtggaggccactattgtaagtgaaataactcagaaacagagacaaatgtcctatgttctcacttataagtgggagctacctaatgtgtacacattgacatagagggtggaatgataaacaatggagactgggaagggtgaggaggaagggggtggatatgagaaattatttaatgggtactatgtgtgttattcaggttatgaatacactgaaagctctgaattcaccactatgcaatatatctatgtaacaaaattacaattgtacaccataattttacacaaataaaagataaaataaaaaagtctttccacaaaactttctgactcaaatagtttcacaggtaaattatttcaaaaatttaatgaaaaaaaaatagcaccaatcatatacaactcttccaagggtagaaatagagggaatacatccgaactcattttatgagaataatataactatgcaaagaaaacctgacaagaacattaagagaaggtaaaattacaagctaatctctcttttgaatgcaaatagaaatatcttaaagaaaatattaagaaaatcaaattctctatgaaaaggataatataacatcaagtagggtttattctaagaatgcaagggtggattaacattcaaaaataaattaattaaataacaaaaatcctatgatctcaatagatccagaaatgtatgtgaatattccttatgatttaaaaaaaaaacaaaacagacaacacagaaacacacataaaacaacaacaccaactcagcaaactcacgaattgaagagaaattctctagtggatacaggaaatttacaattttcaaaaaagcaaaaaccaaacctagaacaaatgttatactagtggtcctagctagtgcacacaagtggtcctagctagtgcaacaagtcaaaaacacttataaattaaagttatatggaatgaaaaggtagaaataaaactgtagttattcacagaaaacatgactgtgttataaaaaattcaaaagaacccacaaagtctaatagaattaataagtaaatttagcaagattcctggccaaggtgaatctctctctctcctctctctttctgactctctctctctctctgtgtcatagatagatagatagatagatatgaattgttttcttatatagtaacaatacacatttagaaaataaaacttaaaatgataccaattacaagagcattaaaaaatctaattgtagaaatgaatctaacaaaaagtatgcaagtccactgtgcagaaaactataaaatattactgattaaagaagaataaaataagtatgaattataatgcatttatagattagatatcagtattcccaaaataccatctcaatcaaaatcccagcaaattacatattgtagagattaacaagcagattctaacatttttatggaaataaaaaggaacaagactaactaaaagaatctaaaagatgagcacagctaaaagatttacactaccagatattaagatttcttctaaatgttcactacttagtcatgcatcattgatgcaagggtaaataaatagattcctggaataagagtccagaaatatgtccatgaatatgtaggcagtacatttataataaagttattgctaacatactcagggaaagtatttttgacaaatggcacttgatcaattttttaaaaagaaaaaatgaatcctgtccatccttgcccccatctcacacctaacacaaaaaaatgaatttcaggtaaaatgcagacctacattttaatggcaaacaataaagattctagaagataacaaaggaaatgtctttatgacattaaggtaggcaaaagcttttccatttttttgtttttgttttaaacaggatagaaaatactaacactaaaagaagaaattgatcattgaagtgcattaaaataaaaaacttttgtaaccaaaagacaactataaggtcaggcgcggcggctcatgcctgtaatcccagcactttgggaggccaaggtggccagatcacctgaggtcgggagtttgagaccagcctggctaacatggtgaaaccccatctctactaaaaatacaaaaattaactgggcatggtggcataagcctgtaatcccagctacttgggaagctgaggcaggagaatcgcttgaactcaggaggcaaattttcagtgagccaagatcgcaccactgcactccagcctgggcgacagagtaagactctgtctcaaaaaagaaaaaaaagacaattataagagagtaaaaacataagcttcagaataaaagtagatatctgtaataagtatatctgacaaagaagtatatatcagaatataaaatgaaatcccagtaacttaataataaaaacagaaacaaacccaactggaaaatggacaatacctttcaacatgcacatcacaaaagaggatacccaagtggaaaataaacatatgaaaagacgcttaatttcactaatcattagagaaatgcaaaccaaagccatcatatcatgggctaccatgtcacacatgcctgaaaaactaaaatgaaaaaagaccaagtgttttcgacgagtagaacaataggatctctcttatacagtagtccccctttatccatggggaatacactccacctcccttagtgaatacctgaaactgcaaatagtacccaatcctacaaatactatgtttttttcctatacataaatacctatttaagatttaacgtatttatacctatttaagatttaatttatttaacattaatgtataaattaggaacagtatgagattaacaacatacttaatcataaaatagaacaattctagcactatactggttatatgaatgtggtctccctccctcctcttctctctctatttccctctcaaaacatctttttgtacttaagggtgagcccttcttgtgatgatatgagatgataaaatttgggctgcagctgactacggataactgaaactgtggaaaactgaaatcatgaatcaagtgggaggggcattactgtgctgctactgatcatgtaaattggtataataacattgaaaattatttggcactatctactaaagctgaacataagcacaccagcaatatcactcctcagcatatatccaataagaatgcttaaatatgtaaaacaagacatgtagtagaatatgcatgtggccaccacaattcataatggcttcaaactggaaataagccaaatgtccatctatagtagaagagctgaaaataataataatagaattgtgattatattaatacatggaaatattataaagcaataaaatagttttaaaatctgcaagcacatgtaaatgcaacataatataaatgaatctcagaaacataatgtgagcacaagaagccacatacagaagaatatataatcacatgattctatttctatatttttcaaaaataaactaatattagaagtcatgatagtggttatcctgaggaagtagagactggaaagatagataaagggatctttgtggtctgctaatgtttttttattggtctggtgctgcttacatgaatatgttcactttgtgaaaattcacttacctatatttttataatttctgaatttgtaactgttttcctgcactaaaatatttcatttaaaaattatctttaaaaacaattgcgaccataagaatttccattgcttttgtttttttttctctgttttcctgctacttagccttaaatatgggcatagtcacagaaatgtgcatatgaggtaaataaagccccagcttgctggctggaggacataaaggggagctccaggaaaactaaaaaatactaatgagagcacagagaaaaaggggctgcagaaagtgatcttatagggttacaaaattctgggctcatctttagctgtacatgcatggatctgatgttaatcagcatatgaatacaattaagaatgaaattaacagatagaccaatgtctacatccaagattgttcactggtatacacacaggacagacctgaaaagcaccgtaagcaaaactgatattgaaaccacagaaggaatcttgtatcttacaacctgaacctaaccaggtcaattgccttttaaaacaaaaatgtcaacattctccatagaatttcaatatgactcagaatctcataacatgatattaagaatatctaagaaataatcctaaatcaccaggcacaagaagaactaggaacatgtgaactcatatgagaaaacataatcaatggagataaaacctaaaatgacacagatgttggaattgtttgacaaaaactttaaatttactattctaaaaatgctgaaacaagcaatgagaaacaggcttaaaactcaaaaataaaattttaaaaaaatacaacaaaatatcactggatggtttccaacaaaataaagataatacagaaaacagtcaataaactttaagatagatcaactgaaattatgcaatatgagcaataaagaaaaaaagtggctcagaaacctgtgggacaataacaagaagtctagcattcatgtcattatattaacagaagcagagaagaaagagtgtgctatgtgttgaatgccccctccaaatctcatgtggaaatttaattgccattgtaacagtgttgagtatcaggacctttaagaggtaagtaagatagactaatgtcattaatgtgggagtttattagttatcacaggagtgagttgttgataaaaagaatagtttggcccagtgtcctctctgtcatgtgctttcttgccacatgatgccttccatcatgagatcacccttgttagatgctagcatcatgatcttagacttctcagcttttagaactgtgagccaaataaatatgtctgttctgtattaattatccaatttctggtattcttttatagcagcagaaaattgactaagattataattctgaaaaggtatttgacaaaatagtggctagaaaattctcaaattctgtgaaatacataaacccacagagtcaagaagtacagcaaaccccaaacagaaaaaaaaaaaatcaatctctggatacattaaaatagaactgctggaaattgaagacagggaaaactgtcttgaaagcatccagagaaaatcacacattatctgtagggaaacaccattcaaatgactgtggaattctcatcagaaaccatgaaaacctgaaggaaatggcaccccttttttaaaggtctgagagagcacagagaattctatatcctgtataaaagagacctgctctaaaacatttgctgaaaggaagctctccagacagaagacaaatgatacaacattgccactgatataaacactgaacattaggaatgaaggaagaggaaaaaaagtgataaacctatgagtaaatataagaaacgattattcttttgggttctttaaaacatgtttgacaatttaatgcaaaattacaacattatctgacggggcttccaatgtatgtagatataatatatgacaaaacaataatgcaaaactgggagagtaaaaggacttatatggttgtaagatttctacattctatttaaatgtctaaaatattgattctaagaagagtataaaaagatatgtatattgaacaactttagaacaacctctaaaaacaactatacaaagaaatatcgtcagaagaacaatagataaatttaaattgaatgctaaaaaatgttcaaataacccaaaacaaaacagaaaatgaaaaacaaaggaaaacagaagaaacaaacagaaaacaaaatataaaatgaaagacattaattcaaatgtaacaataattacattaaatgtaaatggcataaatataccaattaaagacagagattatcagaacggattttttttaatgacccaattatacactgttttcaacaaatttacttcaaatataatgaaaaaggtaggtttgaagaaaagtgtacgtgctgcaaactccaattataataaagctggaatggctatattaatattggacacagtagatctcaaagtgaagaaacctgccagtgatacaaaggacatcatataatgttgaagagttaattagccagtaatatataataagtctaaatctgtatgccctaacaacagagcttcaaaatacatgaagacataaaaactgacagaactgaaaggtgaaatggaaaaatctacaattatatttggagatatcaacacccttctctcagtaatagactaatatataattagtaaaaacagaactgaaaaaattagcttcataagagagagcatatgatcattcagaaacttaacagcatttaagagattatattccttaccaaatttttaggttaacatgagtaaggttttttgatatagccaactacagttttcgtaagagtaatggttacttcttcagagataagtcatatcagcagaggcagaaagctgagaatgggggaggtcaaatctttgtaagatgtaaactgaaaagaaagttttatagaaatgaatttctgctgatctcactgtgaaagtgcagttttcatacttttatgaaacaggcttgttactttgtttaaatatttgtgtaatccaaatagttttgacttcagttaagctgaatatttgctttaaatatttgtttttaaaccccatttatcaattctttagaatcttatataaaaggtacgtggtacttgcttaggaaaataatcaaaaatcagaaagtggcccttttaataatgtgaaatgattcaacaaacagaaaaccaatattttcttataaaatcagtaaggtggtaggtaggtagctataaaaatatttagatttttactacatattaatccttaaaagaaatcaggtaatgagtctgaaataagtttaatgtgtccttcttatttctattttagttacacacacacacatatacacacacactcttacagatagcaaaatatgctaaataggaagtaaacatggtactatggtatggattagtaagaaagtcctaccttagatagcattatctgagaaagtgttttttactttaagaaggattcgactaagcagtgtgagtttaagtgtcagggccagtgccagcatgcttcaatgagaacactgagaataagtgaaagttgaattgtcactggtttcttctaagctaagataaggtttggggcacctaaagtgcactcaactgcaaatactgttagaggccactcatcttccaagggaagtatcaggggaacataaaacttcattgagttctggctagaacaacatcttatgaagctaggtagattccatgtttctcttgctgataccaaggaacaaaggtaaacaaaggtgtcttcacttgcagctgccattgctgctgacaaagcttatctgcccacagagtggtgaatagtaattctaaaggaaacttcttgtctgccaagtagaactttgaagttctgtgtcatcccatgcaactaccccacaaagagcaggtgaatcctgaggtgaagggcactactgcccctatggtgccctgaaagttggagatcaagctttgagcccttcaccaactcaggataaaccagcacaattagacctcctataaatatgaaagaattctgataactccagctccagagattcttggacaagttactaaatggcagtagacagagacagcatagctgcaccttctgctgtatacctgaacactctagctaaaagtcagatatatctatccatgcactaagtggttgaggatcaatataaacaaaacacagttgcctgagttctgtttacagagcacatacgaaattgtctttttctctccacattgtttgcatcattcctaacccctgaattgaattcacttgttagctgcactgttgtgcaggtcttctgatcttgctttactgacttaatgacaaccactctctaaagactgacaaaaatcacactgtttcttttcacactgcccaactgaagtgggccaagttctcatcatcttagctctagtactcaaccttgaaatcatccacagagatgtcttccatgcaagatatttctcactgtaagggaagatgatggtaagtcatcatcttcaaatagaaatgatagctccaaagaggaaaaggaaaaacaactgccactccatcacctctctgactttggctttctagggaatcagttcttctgggtaaggttaaaccaacaaacaaacaaacaaaaaaatggaggtggggggtgtactttattctgttttgtttttaaagaaatggccacttttcatagatagagcaatataagtggaaaataaccaggaggttttagtgaaaatggaaaaggaaaaggcaaattttgtgacatactaggtctaacaattgtttaaatctaaagtttggtgccaaatagtgatggttttaattaatagatggatctgaaacacccatatatcatgctaaagatttagtattaaatatgttctactactgaaaataataccaaggtctctaacgacaagataaacacatgctatattgacaaaagtatgcaaaaaaatgctaatcaaactcagctcataggagcaggagctgaattgaatgatcttgttcccccaaaataaacttccaattcactactcaggttattttccaattgtcactgggacaacacaacaaaagcaggggacaaagttaaaacctggccttttcagtcaagcaagtggacaaatactcaagacaataacccacaaacaaggaagatgacagcggaaaatcccccacattcagttcacccctttgtgaccaaaccctgttctgcaggtcttctgatgacttagactttaagacagcaaggtagacatcctggaaataggccaataataatcttcaactaggaagacatactgaaatcactagggaagcttttttcaacataacctttccctccctcagctgggaatcatagattagatttaatttgtataatcacttcagtttgaagtaggtggatgacctgaagaaaattaaggtataatggcaggcttgccatcagcaagtacgcatttacaaacattttgacaagctatatctggaaatatcctgaggatccaagaatcttggttaactttatacaactacgataaattgggcactacaccaaaacatgcaggctatttgactctgcattttcctcaatcaacaacatgtaacggagaggcctaatataccaaatcattatcgaacagcttagggatgactcactttgacaggaagagcaaagtgtttcactctcatctcagtgaacctgttcatactgacataatgccacatggttcctaatacgcaacaatgtacactgttccagcaacatagaggcagctttgagcctttggatccaaattctgtgagtgagctgggctagagttttctgtttcccttccctcattatcatggcaacagagggcaaaggtggcagttaggctttatgcctggactgctggcatacaggtccacacctcttccaaaacaaaatttggacaatagttacacatgaaaatgttgtgttctgcttaggttataaggaaactaaatcatactgcaggcaactctttagttattttctcttttatcctatcttcaccagaaaatttaaagagctctaaaacagtgtttctcaaactgtaggtcacactgtcagtgctcttgaaattaagatagtgggctgtagactttaaaggaaagttaggataagataaaataggataagataaagtaggataggatgggatgggatgagatactagaggatagaatggaaaatgcaacacataggaagggtaaatactgtcttatgaaattttgttttaattatatgactgcatgtagactgtgtcatgatttaaatgcatttatctctgtggattattaggaaaatgtatgaaaaccactgccgtaaagaacatctatcttatggccctaacagcatttctctacagaaacactattggctttgtgactgggcaaatctcttttctaagtaatttcagctattcatggcaggatttaacatcatatctttcccctatccactgaattccagtagtgcttccttttcatcgtgacaaccacacattttaaatgctacctaggaggagttatcaccatctagagataaatatgaatccatagacaaaaggttgctagctcaactcatatctgatgagaagcaagtgtttctaagtatccttttgtatctagagtttgtcctccaggatgaatggaggtcagctttgatagctcttatctgggacgtgtacactgttccagctacttattctgcaaattaagtcttcctttcctagcacccatcaatctaatactaaattcattagcaaaatgaaatgaaaagaacacaacatacattgctattaatggaattccatgcatgtcactccccacacattgtactaaaaatgaactcatctccatttgagtgtctctacacaaatatctgtgtttattaatacacagcatttcagaagtgagattttccttaaagctgtaaagccatttgctttgtcaagctcccttttcagggaaaaacttcaggaattttcactatcaatttatgttgattatttactcttttgtggatctgctattctccaggcaaaatccaataaggagaaatcatgattactgtctaaagaatttattttgtaatattttttcttacttcctgtaacttactttgtgtgacagtaataaacagttcataatgctccatctactatcctcatccataaaatctagtaacagttcaacatttaaaaattttttaatgaagacaaaaatcagctggtgacttcctactggagcacaaaattaacacttgcactggagtgggtgagattttcttattcagagcagaatacagtctttttcttacggatttaaaaatcttagttacctttccctagcttgaaataataggcattttgggctgggcgcagtggctgatgtctgtaatcccagcactttgggaggccaaggcgagcagatcacttgaggtccggagtttgagaccagcctggccaacatggtgaaaccccatttctactaaaaatacaaaaaattagccagggtggtggcacacacctgtaatcctagttactcaggaggctgaggcaggagaatcacttgaaactaggaagcggaagaagttgccatgagccgagattgcaccactgcactccagcctggccaatagagtgagagtctgtctcagaaaaaaaaaaaaagaaagaaaaagaaagtaataataggcattttgaagacttcaggagaaatagctagaattcataaattacccagaagtgataacactgtacttagattttcacacataaattttcctattcctggatagtgtgggaccaaactatatataaccaagttttaaggtgaccaaaaattaaaattcacaaatactctgaatgtctcaactactttccttccagaaacccaagaaaaactgaagtgatttctcacttcccctaatgagcactaatgacaattagagatgaacagctaacctcaaacacactaaagagtgtttttaaaacagaataccacacaggttgtataaggcttatcttcaaacattttcctcaataaaatgttaataaacaaaaaaaattgacatgagggaaaagagaattggaatgaagaatatcctcctttacttttaaatgacaaaattaacaaacatgagagaaaacaccatttttaaaatgaaaagatcactcatatgagagaaggcagatcacatagtggaatgtctaaggggaaatccaggtggattgcccactggagtatacagttaaaaaatatccaaaggaagaaagaaaagacattagatatttggaaaggtaagtaactaagtaaataaataaataagaaaaatgatgacaaatttgcaagggacaccaacaccaaatgcggtttttgttttttgttgttttgtttgtatgccaaagagaatcagtcagctagtaacaagtaaggaaattcaaacagtagttgttctaggtcaaaaacaaaagatatatatgtacacacacaccacacacacacacatctatatttatatacatacacacacacacacacacacacacacacacacttggagactctcatgcctcaaatatattttgaagcatacaaatttagagagtctagatttaaaacagtggcaaatacaaaagtctttcttaattaaaaagctagctgcagataagtcactagcatcaaataggtaccaatcaaaagtaaaactgtgctcagaaaaactaacttgttcttaaaatggccattttcacaaagtactgaaagattggcaatgtggccaaattcccccaaaaaaggggtttagaagcagcctttgtaaccaaaggcaaacagtgggaatatgtataaaacaggaagatacacgaaaagcttttgcccacttggtgaattgagcctctctatctaggcttcttgtggcattaaagaagcatctgcaaatgcagtaactagaatatataatctattcagattttcaaaaggcttttgagaaagtttcatagcaataactgtgcaaataaattttgggtaaacatggaattagaaatacatattttcacaagcacaaaactatgttagatataggaagaaaatgtgaagtggaaatgatgagagaatgcttttataaattttgactgtggaattcaaagtgtcaactgcacatatttatatttcactatccttttcaaatagtaaaatatcaaaccacagcatcacggaatcctaaagagctgggatgactccctacgtactacagattaagaaactgagctacagaggattaataattgcccaaggttaaaacatatagacatcaggaagatttcataacgtttacaaacttgaacaaaaagtaccacatgagctcccctatggggatgtgttgagtattatatttcactagtgataaagaatacaaaactgttcacataaatgtggcctttaaaatatggtccctaaacaagaaccttaaaagaattataatacattccctgaaaacatttcaatgtgttctggttacaaagatattcaaaattctagacatcatcagaagtgctttggatccagtcttagggagatccaacatttaatagctatcagaaaaaaatgcctgcaaaggacatagtgaggatatcagaaaaaaatgcctgcaaaggacatagtgaggaaatgacaaggagcataggaagaaaatcaagaaagcatgacgccatgaaaaataagggaagaaagcattgcaataaggaaggagtggtcagcaagatcaaatgctcagtgaggtcccagtgagagttaatttggagaagtgatggaggtccctgcagcagacaaggtgaattgctgaatggattggtgaagaaatggaaatagagagtagaaacatttctttgaagaaatgtgagtgtccttctacaggtaaaaaaaaaaaaaatacatgataactggtcaatctctgaaagtgtgggtccagcggttttaagaggagattcagtattacccaccatactcgttttttttttttaaccataattcctagtcaaatatgtcataagcccaggaaaaggatctcaaaagaacttagaactatcctccttcaatacaaaaaataaaaggcatctggtttgcagtagggttgtagaccttgcaagacttctgcattttggtttaatcagagattttccagaagtctaaaaataattattcatctttgaaaaataagggtaccatacagctatctagctctgtaatccaaggaaaaatcaattatcttaaaagatgccttatgaggtcattgtttcacatgataaaacaagaacattaggaggacaagtctcggttggaagtctcagatcactctaattgttctaattgatgaatcttcttcaaggaaaaaagtgggctccatttctgtttttaaaaatccagagtatctgtagtagtgcaactaatgacaaccttcccgttgttcttgcctaagaggaaaccctataataagagcttcccaaaatgtcaaataatacttgtctcataacagggcttctttgttcattcaccatgtctcttttgatatgcacagataataaaagttcatataaaactaaaggtaatatagagcagaagccaacactaattctgtataaatatgtctgattaataagaatgctattgttatggttatttcataatgtcacgattgttacaagaacagaggatagaagtactcttactcttactgttttcgttcatcctctgtcatccaaccagtttgcaaatttctgttcaacgggaaaaatgaaggatagatttttgtccattaattactgctgttgcataagttagtctcataaattgtgaaatgagcattaaattcagggaaaaattaggggttttattttaaaattgaactccacttccactacaaaaatgaatacatgctccaggcttactttctaagctcccttttccacatgcacagttgctatattcttctggtgctcatgaacacatgaaagatagaatttagcatgatagcactaaaatctaggtaagagcctagtatattaaacctaaactgtggtttaatacaacaaccatacacaaaattgtatatgggatttggttccaaaaattagaaccccaccctggtgaagtaataagtaaccccacccagatgtgagtatctggtcccttactggaaaggaaataaaaacaagtaataagataacagtctacactcactgcagacagacagcccgatagattttgaaggaaattctaaggctggtagataagtttgtattgtcattattttgcttttctctttaaattcttatctcctagatcctggtattcccccttggggcagcagtataatataaaagcttaacagtcgatcttaaatttagctgacatttttatatccttcaaaacataccttttagattgcacccaagaaggagattattaaatagtagcaggagaccagttagtggaccattttgactgaacaaaaaacagcactgtgccttcttgttgacaaaccaaaaaacatttatatagtcattataatcaatttcataaataaaaggctattaatgactgagaaaaaaagggaaaaactgtatttctcccaagtcccttcatcctctcttaaactccatattagtttaagaaagtggaggaagctatgcatgaaaaatagtgtacttagttgagctggagtctcttgtgaaacaggttctgtcagtcagaaggcaagggtacatttctataattatttaagcctagtttttttgtagtaattagccagagctccattttgctgaagctggcatcactcacagctcacttttttttttcaatttagacttttcattcctttttataaaataaatttacatattttcagtctctcaatccctcctatgttttatttatgaatatagcccttcttgatggtaactctaatgtgaaagaggtagtaattaatgtcccaatctgctaggttaatccctttccacactctctatagagaagtttaaggtaagtaacagtttacagtcaatattaggtttaattatgcttaatgagagttggtgtctctgtttactaactgcatttaggtgtgtggatcctagatgaattttcccttggcctcattctgatttgttaatagtgccactgtgtactgtatactcagtgcttaaatctataaagctgcttctggagaacaaagcaagtaaggcacctgtttcagttgaaacattattaaacaaatgagtgaagttttaccgcaaccacatctttctttgggaaggtgctgttattttataatgctttccaaacaggtccatgtaaaaggctaattgctgcctaaattcaagatcctaggttaagtctatacatattaaaaaatgtttcaaactaagtacaataatcaatggtgagtattttaaaactatggagtattaaacacttctaagactttctgtattaatctttcaatgttttcattccaagtactataattgaaaactactttgacaagtagtttttttgccttgaaaatgtcttttgtcttaaaattatattcaactttgttgctgtgtataagacaaaacttttgtttccttactgaaactataaaaataagcatcaaaacaaacaccttggcctcaaggaaatcagatagtaagccgagggaaatttagtaaacaaatttttaaagaacccctttttcctatatttttgttatggataaattatgtatacaactgaccatgtagtttctttaagtccattcatagtctaatcaatttagtaaacatttattgagtaaatactttgagctaagcacaaaaatgaacatgacatactcccttctctcaagaagcttaccatctagaaaggagccaggcatgagttaaaaactttaataggctgggtgcagaggcttacacctgtaatctcagcactttgggaggccaaggtgggtggatcacctgaggtcgggagttcaaaaccagcctggtcaacatggtgaaaccccgtctctaccaaaaatacaaaaattagccaggtgtggtggagcacgcctgtaattccagctacttgggaacctgaggcatgagaaatgcttgaatccgggaggcagaagttgcaatgagccaagattgggccactgcactccagcctgggcaacagagtgcgagtctgtctcaaaaagcaaacaaacaaacaaaacccaaaaaacactatgctacaatatggtaaatcatactcatgcattaagaagacacagaaaagatcagttgatctgtagaggataaataaggcctctgctggtgaaatagcaagttttttctgggtcatgtgcagactatagcaggctaaatgaacagtaagagcaaaggcagaaagcatggcatccacagtgtatttaaaagacagcaaacagtgaagtgtgtgttgaaagaactatgtgcctgggtggaggaggcggggggtgatgggaagagatatgggagtttggaagttaggggctcaaagagtggactgagaccgaattaagaattttcaatgtcatcttgtgttagcttttatgtaatatgagggataggaaaaggtaaagagataacactactaaacaaggataaggtctgaataaattccttcaaattaaactgaattcttctaagcctactgatctttgaaaaacattttcaaatttcaaacctcccataatgttatttggaagcccttgcatttagatcaaagaatttgtgccatgtggaaaaaaattcctaaaatatgtctatctgaaagatgggatgataacatattaatggaagccagtagaaagagaagctgttaggtttataccccagggaatcctgagaaatctgcaaataattaaatgtactttgtgatataaaaatctgtttataattaatttcagaaattttctgccttttgaaaattctcccttagttaatatatcatgatgttgtttttgttttttaaattttaattggcaactaaaagttgtatatacttatgatatacaacatgctatttttaacgcatgccttactccacatatttttgtagtgagaagacttaaggtatactctcatagcaatttttaagtatagagtatatttttatttacacaatgtacaacatatctcttcaacttattcctcctgtctaagtgaaattttgtaccccttgaccagcagctccccagtctctcatcccagcctctggtaaccaacattatactctccgtttctatgagcttgacttttttagattccacatataagtgagatcatgcagcatttgtctttctgtacctggcttatttcacttaaaaatcctccaggtctatccatgttgtcacaaataacagcattttcttttttaaagatgacttacattgcatcatgtttatgtatattattatctattcctccattgatggtcacatgataacatccattctgacaggtgtgaggtggtactcactgtggttttaatttgcatttctccgatgattagtgatgttgagcattttttcatatacccattaaccatttgtatgtcttcttttgagatacgtctattcaggtcctttgcctatttttcagttgggttatttgttttcttactattgagttgtttgagttccttatatattttggatattaaccccttatcaggtgtacattttgaaaacatattcttccattccttaggttgtgtctttactgttaagtgtttgcttttagaaaaataaaaaaagaggcaaacatttccttaaaatccataaactaatgagttttaaaagaaaagaatgccatccaaactacctaatcagaaaaagactttctacagcttagatcctgtttttatagtattttagaaatgtctaaacacatggcctatgacaaatacttgcctctttttggaacatcaattacttctttgtaacggtatactgatttccttttaaggaataatctctttcccttccagtatagtattggtgagacggtaactccaggttcaaagataaacttggggaaattaggtagataaaaacagagaacatgcaaaaaaataaagaagcacacgaggtgaatgaagaaaaatgtagcaaatttatcagaaagatggaaattgtttaaaaaagttttaatattttctaaatatggtgaacatttctccaatttaaataatcatcagttatttaacactttctatgtgctaggtattcaattcatcaatttattaataatatctccaatcctaattataaccccaagagatagatgttattttttccattttattttatcggtgtgtaggcttaaacccagagaactaaagtaatttgcccaactgttagtgaatagttcagtcaagactgaatctcaaatccagtggaaaataaaatggtatgtccagtataggaagtacaaaacatacaggttaaataaacaaacgttcacatatacctatcaataaagaactccaaaattacatcagtctgttaaaaacaagccactcaaagctctagagttaactaaggtagtaacataattctgaaattaaaatgaaaatatttacataaagttaaatatttttttaaaaaatctttaaaaagtacactcaaacatactgggaaaacatttttcatgggaaacattttaggataatactatctattctataagaaaagagtcaccttcctgaagagttctttgctttcagtgctgttgcctaaattaactttctgttatgaaacacatcacgctagttttaacctagagaataatttgaacaaaaccaagttaaccatttctaaaatacttaaaatacaaagaggtggttgtgtaaccttgaagataattattcagatgtttttaagtattcatctctccatagtattttagatttaattttgtgaatttagcaacaaagaacacagtttagcacaaaatgagaaaacctgttcagaagtgaagaaatcatctaaatattaatagattttattaaatagcagcagaaaacgttatacttggtgttattttcagctatataaatatcttatttttatccaataaaaaacatactaaattcctccatttcaaatactgatgatatcagcaaagtgttcacacatctggatatctttctgtgtttacctaaactgacctttctggtatgtactgtactttctatctcagtatcttcagtgtacatttgcaaaaactacttgaacagtttacattctcccacaccatgctacttcaaatggtcttcaagactttcaaattactgtcagacactgggcattttgtaggcatatacttttgcattcctcctcaagggaaaaaaaaggggggaaagcctagattcaaatggtaataaagtctctttcaccctgataaatacatttaaaaagttgatctcggctggtcgcagtggctcacgcctgtaatctcaacactttgggaggccgaagcgggtggatcacccgaggtcaggagttcaagaccagcctggccaatgtggtgaaaccccatctctactaaaaatacaaaaattagccaggcgtggtggcgggcacctataatcccagctactcaggaggctgaggcacgagaattgcttgaacccaggaggcggaggttgcagtgagccaagatcaccccattgcactccaacctaggtgacacagcgagactctgtctcaaaaaaaaaaaaaagagttgatctcatcctgatgctagagttgtataaaagaagatcttagtgttaactcacaagctattatataaaaatatttgtatatatgtataccaatgtactatgcataaacacatttgaatatagcatgcgtatatatgcaatctatttagtatatttgaatgtatatattatatatagatacatatgcatttacatttccacatttattccaaaaacttagagagaaaatacttaaactgttttcaaaatacaaattctaaatgaaataaaatgttctttaaaaactgtaattaatggctgttatgtcaaactgtgaaccaaaaaggtcaaaccttataatttacagtttgagaggtcatacctcaaattataaccttaaaaaactgattatttgtgagtaatttgacaaatgcatctaatataaactgaatgcatatgaaatatttttgcgagtaaaaagaatgtatgtccaagtggacagctgatggaggaaatagccttttactgaacaaggctgaagtccaacataatgacttggaatgcctttgaataagcatgcaggttggaaggccaaacagtacacacatccaaaagggagcataatgaactatctgatcagaagacaaaaatactccacatatacacccaatgagaaaaaagaaaacacacttcggtcacctcctcttttttcatcattactataccccaattcacgaatgaactctgggctattgataaataatcatcaaaagaaatgatttttataatttaaaaatactagaaattcctataatattccaatctgagattttcaaatgtctatggagatcttctatatcatataaagtaagccaggtttacaaaactgtttacgactcatcttggatgcaaatattaccacacctagcttcatctcaaagccacctgctccttaaaacataatctgaaatactttggcctctccacaatttttaatctacaagtcatccaccattaagaaggcagatcattgaagataattttctccaccgtagactcaattccctaacccaagctagaattgagaaggttagcaaaatagtcatttattaatatatctatgtctctaatatttatttatgtgcttattatatctccctgttagactataagctcaacaaggataaagactaagtctcttttgttcaacagttatctataacatctacaaagtttctggcacagagctagcattccataaatattcgctagaaaatggaaagaaggggttgacagaagaaaggagggaggattgagttagctagtctcctctagtattatttgtgcaattgtggagagaaaaatccctaaaaatgtacactgtatttaatcaatttacccatccaacaattcactgatacatcgatccttgaaaccaaaaagatttaaaatggcttccaaaagtacacaattatacaataaaataaattaaaacagatgaaaaatgaaagggatacaaaatatagttgggaacaggatatttctatacgtatactggtaaagtcagttaaatcacaggaaagagaaggaatttgctttttaatttctccaatttaaccttattgtaactactattataatagtgttataaacactaagcaaatatttactcgttccttatctaaccattactatggcaaatactctataaccaggtaccttatattatgagccaggcaatctattggatgagacaaatattcagttataagaaagtataatatgtatgttataacagtaaaattatagatttttgtaggagagaaaagtaggattctctgaaccaacaaaaatgcttacatggtaactgctgaactatgaacccaatacttcatgtaccaagagatttttctgatacatgtaaatatgcatagttcttgatacacagggaaatatgtggtctcaaatgttaccagtacaaatgagacttgcacatgtaaatcacaatatgataagaaaacacatttgaaaagcattatctttcttgtaagtgaaagcttaaatctgattccacttagcctggtaagtgtttttgtcattccgttgggccagcccacacatactgggctcttgataggtcctgggctcaaccagctggccctttgtgtacttaattctttttttaatactgacgagtgtattagtaacacttccttgatcactggtaaatatacagctaccacacaactaagattttccttaattctgaaattcactaattagttgtgggtacgggttagtattacaaaggtatgttgagtggtactacaatgagtaatgtaattcccaaaaagaactgtgttaatttacttcccacttcattagaggaataaaaaacatcttattatcactaaaggatacagaaagagacctgggtattttagggaatggtagacagggagaaagcatgaatgcagcattgaggcaagaaacacaaatcacctatacatcttggacaatgttcgtgcttcttcttaatactttctgcttgcttcatttattagtgtgtttcatgaaaacattttattcaattaataaacaggtttccaaagaaagcaaataaggtaaatgattcctattttcaaaaacttatcattctactggtacgtaagttatgcattagtcaactctggaagctgcattaatcttttcaagccaataaggtcacaatcaattacttgagatagcagaataaaatacaggcttaaaagaaataatgcagccgggggcggtggctcacgcctgtaatcccagcactttgggaggccgaggcgggcagatcacgaggtcagcagatcgagaccatcctggctaacgcggtgaaacctcgtgtctactaaaaatacaaaaaattagccaggcatggtagtgggcgcctgtagtcccagctacttgggaggctaaggcaggagaatagcaagaacccgggaggtggagcttgcagtgagcccagatcatgccactgcactccagcctgggcaacagagcgagactccgtcaaaaaaaaaaaaaagataatgcaatttccaaaggtgctaccaagtcatttagagagaacatatggtacaattatgagtatcaaaactgggaatttatatattttaagcctaccataaaacatatttactttttttcttttgttggatgagagatattctaacgctgtttattttttcggaagattcagattattcaaagtgtatcagctgattgttatgtgtgttaattcaagcactgagtttaaataatcataactcaactccctaaaactgaagattctgtgtaaggttgggccagtgccctcattcctaggatcaaaccatgtaagaccagacaaaggtctcagagattttggggggttccagtctttctcctttgtccatagacgtgttagggaaaggatgacattttcttatagtacttaccccaaataactaaaatctcaacaaaaaatagataaaagtgcggattgtaaaataggtgttaataattccttaatcaaatcttgtaactaatgaaaaaacactagtttatatgcagaagtaaactgacgaaaggatgaacagaataaacaaggaggaaaagacacatttttaaatatgtaatttagaaactgtcaaaaaaagtgggacatgtcttatttaactggtgtatgagaagaatggatggttttacaggcacataaatgcaggtacagaaaggtaataggagctttgtattacaatggaacttaaactcctctgggcagtgatcagctaagatggaacagagacagttacaatgcaatgattaactagtggacaaagctattatttatggcaggtatgtaagcaattggggcagcaatgttggaggcccctcctcatcaagcagctttgccagtacagactggatgcctggaaccaggaaagacacaaaaacaataaaacctagagccagctaagggagattcaatgcaatccatctccaaattttaaatattactggaaatctacactgaagaatgttttcccttgggattggcatacactgtggttatagaatgttgaccaacacttacctttatttatctcactatgcagagcaatatgcctaaaatacctacttagaaattctcattatattacagaaaaaggagattctaacattagttggcaaaaatttttgttgataggcatgaacatcatgtcattacatgaacagatcattaaagtgagtccatttcattgacagtatatattgtgggtctttttattctgaacaaccaaacaaaacaaacacacaagaggtcattgtgccttccctcatttggttggcagctttatctgtaaaatatgaaaataaaaaactaacatggactacaatcctgcatgtaccattggtacctgcatagtaccatttctgcataagatttaatcaaatattttattcatgttctgaaatcctgatatttgtgaagatggaaaaatacacgggatatttttaactttcaacttcatgatctccagtaaaagtagaaaaataatcatatttcatattatttggttttttgagctagccaaaaaattattagtatacaagaaaaaaggaagttaccactcttcacttgtcttcaggtcttttaatgtaatctcaggaaaaaaacatatttaacaaaaatggaaattatcatgttaaaatctattccactttgaaaagcgatattctttctccctctcagataattttaaatataaacctgaaatgttcataaccaaataaatcgtctagcagataaccaatcaccaaacattaattttacacaatgaggtttctttaatttctctctgtctctctcacagacacacacacacacacacattcacacagacaggttgctaacttgattcttagtatggtaacttaaactcataaccactccaaaatatactttaccttgattttgtgaataaaaataaataatcttatggggcaaggcagggataaaaattagaagtatatttctaactttaatagctaataataaaaagaacagcagaaattactgaaaattatattgctaaaatgtatctgtacatgtggctgtgaaaacttacgtgcaaagagaattctcgttaactaccttcagaaagaggtaatgaaatatgaggtttaagagtacatctttagtacttctgtaccttaaaatattgccgagtattaatttttcatcaagttgtcattttctctgacatttggttttattaatcaaggcatttatcattaatttgtagaaaatatcgtaattaagccaaataaaataaaatccttaaaaggttaaaattagaaagcaggtgaattagaactttgacattaccctgttgacatacaggagctttctggaagtatgagaatgaagtttttttcagtgagtttggtgcctcgatcttggggctggctggtttttaaaaaatgttataaagatttgatttaaacctctctgacagttttgacattcaggtgaaagtactgctgctgcatttggaacaatttgcatatcccactgctaaacggaatgtttgaggtgtgcactggtgtaaagaaattaaaaacaagctatcacacatgcttaagtgtatgtattcacaaaactgatggttggatcgcaccaccccatccccctccaatgtaatctgtgatttactcttctataataaattaccctaccatgttagtctcactggaaaatctaaccatgcatgtaagaagaaaagtaattacagccccctcttgtctaagaagcctccttcaatccctgtgagctctttatacacaatgcagccacacgagtctattgtaaacttcttgcctgaaattctggacttctgactatcagtagccactaaatctcatctgaagagtttcaatgtccccaacaaatacaattttatttcttatagttaattgtaaagctcttcctcaggagaaattgttactgacattctgactttaagccaatatgtctgtttaacaaaagaacacagtttaaaatcatgagttccaaaccagttaaaaaaaaaaaaaaaaaggaggacagagggacataatacataatgaaatagaaggaacaagagttagagcaacacctaattaagctgaaatattcagaaagagtataaaatttctactttttaacttacaatttcatattatttttaggtatacatagaaaaagatatttaatgtgtttaaggacaataaaagaaaaataataaaataaaagaaaagttgaggtagcaaatccaagaccttaaatattataagacaattcaagaagataaagcccattcaggaaaataccactggacattaccttcagccttcagagtcccaaaggcaattcttaacacttctttttatttgtctgtaaaaaaaggaatacttaaaattagaaatctgccaaggaaaacatttgcatttctataatatctttatgacccaggtagctgagtttgtgtatgccaactaatatctatagttttaaaaagaaaactgaaagctaacacattcatatgtgtacaagtactcagtaaaacgtggcccaaatatacaatctaaaccactgcatatacatttttgaggaggcatagcacggtgtttgctatagtatcataagaagttatcttaactcataaggatatttgcatttttatttcatgttttcttttaagaaaagcaaatcccaaattgcttttaacctatttacttgctcattcttattaacagagagttcgcaaagttctatgatgtataatgtactggtcatcactggtgagtttaaaagtatgcaaagataaaacacaagccctattctcaaaatagtaggtaaggttagagatatttgcataaactcagataaaccaaagaaaataaaaagaaaatgggtggaaagaaataaagatgcaaagggtaacatgttcagtacagcttagtacctaaggcattgacattaaaacatggcttaatatttcctgttttagcagaaaggctaatagtagggtcctacccatatttagatgcaaggatgccaaacaaatggatgggttgcttttaaatttctttagtaaagaattgaagctggatgggaacaggcaggatgttgagtttactttaaagccaatttggtgattttgactatagaaagatttaactaaaaacagctctcctattaaaaattgaatttgatgttgtgttcccattagaaaatgatctctctaaatttgctatgaaatctcaatgatgaccttgatgccacatttactaataatctccacagagatttaggcattcaaagtttcaaaagcagttttaataatggaaatgcaatacctaaacatatgcttgattatataatctagtacatctacagtaaaatgcccattaaaattttaaaaatctgaggattttaattgactatatcattaatatgcatgcacagtatttttgcaaacaacaaaccacactagtaaaccaaaacaaacctaaggattggttgcactaatagacaaatagggtccagaaaaggaatctgacactcctgttatatttggggtgcatcagcattattacagttattctgcatcagcaaactaggagggatgctaaaagttagtaactgctaggaggagtgagaccagaacaattaatgatgaagaaataggatgattaggaacagaaaagaaaaaatgttctgatcatagagataaagtggaggacacctttgagaaaattaatttggtaactacatgatatattacaaaagttacttttattaatttattacctgtctcttcctctagaatggaagtaacataagggcaggcactttctctttttcactgtaaccccattttcttgaatagtgcctgccatatactaggatatcaatgaatatgtactcagtgaatgaatgaacagcctaaccaataaaacaggcactaaatctgtatctatttacagatgagaaatttaggcttaaagaaattaaatcatgtacaccaaattaaattgtcattctgcaactacaaacttctacaatgcattctttattcttccattcaatattcattctagcaacaggagaaacagacaataaacaaataaactgttagacttataatgtcatataattagtactatgaagtcagataaaacaagataatgacactgagagttacctggcctgatattttagatagatttggacagggaaacttctcaaaggacgtaagaataataagaaacctgaatcaagtaaagaagacagtcaaaacaaaaaaatctgaaggactggctgggtgaggtggctcacacctgtaatcccagcagttcgggaggccgaggcaggcggatcacctgaggtcagaagttcaagaccagcctgctcaacatggcgaaaccccatctctactaaaatacaaaaaattagccgggcgtggtggcgggcacctgtaatcccagctactcaggaggctgaagcaggagaattgcttgatcctaagaggtggaggttgcagtgagccaagatcgcgccactgcccttcagcctgggtgataagagcaaaactccgcctcaaaaaaaaaaaaaaatctgaaggaccgtttgaattgttttaggattaaataatacatatttccttgcctagtataatggccagcatataccaaacagtgtactcaatactttttattatattgctaatatttttataaattatgtttccccactagattacattgtcaaaggcatttactgttattttccttaaggttccttaaatagtgcctagcaagagctcaataaacacttagagaacaaaaatagaaagacacaattttcagttcattaattagaaaataaacagactacatgaatatgaaaaagtcaccatctttcgtatacctgaatcaatcaaactctgttaaatcaatttcacataatatttcacctttcctaaattaaaaaaaaaagaaaaaggggaaaatatattaaatggctagggccaagaagtcatagataacaaaagaataagaaagaatcagaagaaaattaagttattaacatgaggccactctctttactatttacatgctgtctgactccatcagattaacacatttttccagtgaagggacattgctacacagatatctgattcatttatgtattcctaatgcaagcacaagccttgctatgtaacaaataatcaaaaaaatctttgttgtcctgaaatgaactaaaatgatgtttagtagttttgatgctttaaagctagctcaaaacaataacaacaaaccaggggactgacaaacttaaaaaacaaatttaaatgagaaaacatcaagcattaggtttgagtcctatagcaaagaagcagagaacaaggtaggttctttccaaagagttaaatataagtgacagtgtgatattggcattggaagagatagatcagtagaagaggccaggggaacttaggtatggggtaaatgttacaagtaacatttccatgaacaatgttgagatagctgactgattacctgtggcaaaataaattctgttctctaattcttatcagtactaaaatataaatcaggtcaataaaactcaatataatatataaaacaatcaaggacctctaagaaaatacatatgtataattttctgaactccaatgtgggaaggacttttaaagtacatacacagtggtatataatataagcataaagatttatgatgtttactacttaaaattaaaaattttagcctgggcaacatggtgaaaccctgtctccacaaaaaatacaaaaattagttggacatggtggtgcacaactgtagtcccagctactcaggaggctgaggtgggaggatcacctgagcctggagaggtcaaggctacagtgaaccatgatcctgccactgtactccagtatgggcaagagaacaagacccagtctcaaaaaaaaaaaaaaaaaaagtgtaaggcagaaaacatctttaacaaaattcaaacttaagaggccaataaaaaataaatatttttaaagtgtataatgttcattgggttaagagtctttataaataaataaacatattattctactttttaaaatgagcaaaatacatgaataggcaattcacaatagaattgtgagttctcttctaaaatatggaatgcatttataaatatatttaaacatatataaaatatattttaaactatatataaaatagtaatacttattactatttattattaaataatattattaattctaatacctataagtaataaggtgaaataagaagctaaaatacatatgaaataatattaatctgcaatagcaatgaaagaaatgcaaattaaataaactaaaatattttagaatagtgaactggttagataaattatatgtaataggatattaagtgttcattagacatggcaagtgaaaatatataatacatcattaagcttagaaaacaggttataaaatggtaataatgataacataccataccaatatttaataatttttctctatataatataaatacagactatgcacaacttttggttatgtgcatatgtaagtatagatctgtatgtaccaggtgtgtgtgtgtgtgtgtgcttgtgtgtgcattagaaaaagtatgtatgtgactgtaaaaaacttaaactacattattctttgaatttatcttaagattatgacagtttttttcttcttagaatttgtttccaaattttctgtaataaaaacaaattactttttataaacataaaaagcactaaagaaggcacctagtttatgtttcaggaaagaaaaatttaatttatattattagaattcctgaatgttaagaaagacatttgaaaatgtctatctgtcatttttggtgaaacctttttaactgcatagatttttttagagaaaaaaaaatgtaaggaaggaaaggagaaagggcaggtatcgtgaggaagggaagagaacaacaaagaaagaaaaataggatttataaagataacagcaactactcagaatggtatctattaggttcctagcaaccaaattttaactggtaacatctccaattaaactttcaaagaaaagcacagcctggaatgtagaaaacttaagttggaggttacatttatactgtgaacatacttttacaagagaaaatagatgaaatgttcatcgatttcaatgataggactactgtataaagagagacaaaatacaccatgagaacataagatgctccaaatcagttttggaaataggagtagtataaatttcaattaagtaaaagtttaaagtaagcaaattttaagtagctataaaatcatgctgttcattcccatataagaaattttcaatccatagtccttaacatgtcattcaaaacatatgaccctacaacatatgaactatgacttctggttaattgtttcaatggacattattttgtataaggccttcccaatgagtacaaaatgaatagaaactgttaaagaccattatctattaataattatagcaaacaagtcttcattaaataaaaatttaaacataaggtttaattgtattttattttaaaaggcaaatgaaagccaattgatcatcctgaaagatcataaagaacctgtacagttccatcgtcaagaagacaaggatacattccttcaaagactggaaaagctttaatttcagttcatccataatcatgcatcctaaggtggaggtattcattttggatttggatatattattagagtttttaaaacaccagggaaatctggtaagttctatggtatattctcaaagaacatttcataagattggtctggctaaaccccatactaaagccatctgaaataaagtcaaattccatggagctggagctcgagagcaacaacaaaagaccattcactgactcagttatacttgctcttaggtatttcaggttcgcttctaaatagggggaaaaagtacagaaagattaggtactaaatactgtttttaactctaaaatacaatcaatttttttctttacttgtctgtttaaaagtaacccgagcccttccttttattatgtgaagcttcattctgtttatttttatttcccaagagcagaatgccttaaataaattcttaaaaaccaacacatcaacaaataaataaattaaaactcagtgactataaaaagtacacaatctaacctgcttaattattaacaggtaaacacaatgaacttctaaattatttacttaatccccttcaactaaaaactttaaagtttttgggcttgaaatgtatatcctttctaagggtccataaaacaattatttaaaaatctatttagccattttagtaaaagcaattttaaaataccaaggtaaatatgcacttaaacatttacataagttcataaaaaatagaagactttttttaaatttcacaggtcagtaaaattatttttcttccagctttccctagtcttctgtcagatatttcactccaccatgagcagaaatattcagtactaaattatattagattgatataatagttttgaagtaagcatttatagaatactcttattcctgagtataccataagaaatgtataattatgaaactataaaaatattaataattttgaaacttcaagaaaaaaagaatgaataaattaaaaaatcaccattttctccagataagactggactattttcaccagcgtagctaatcactgaagaaagattgctgcttgatgcaagtaaccattgattacctgaaatgttggttagttaaatgttctggttagctaagggttctagggggaaaggtgtttttgtttttagatcattttaactaaaaatataagatgttctactagatttctctgctttagtaaatagggaattataattttatctttcacttaaaatgaaaaaattatgttgccttagaggatggctcttgaacttttgggaagtcagaagggcctctgggacgatgaaaaaaaaccaagaatcttttttctctagaaaagtgcatatgatcacgaaattttgtatgaaatttccagggatccagagacccaataaaaaccccttgctttctaattttacagaattctaaataactagacataggagattgcactcatacagtaacccccaggacaaaaggagaatgtttgaagttccttcagaagacaggcctaataatgagctattttgttatgatttgtaacctttcttctaaaaggggtgtgtaaaaacaattcttgttaatttagtcttggttaaaggttaaatatgtttcctttaaggacaattgcattacaaggtatttgagctttgaaacaaaatagtgctgctttaaaatcattccacattttagaagtgacagcaattttcttcctatatttttgtaacaatagaaggcagagtcaaagagaaatctatttaattttcatctttacttctaaagattaacagataatagcaaatacatgagcagtccccatattcaggttctgttcaaagcgcttttatttgtatttacttatttaaacctaacaaaaactctaggaggtaggtaatatcatcatacccactttatcaatgtgtaaactaaggaacagagggagtaagtaatttgccaaaggacacccttttactgagcggcagaaccaggatttatgcccccgtcaatctggttgcagagttcggattcctacagaccatgttccatttccagctttaatctttcatgagttcttcaatctttcatgagttgatggtttttcttgtgtgttattatatttaacacaagtctacttcttcactaccatgcaaggaactttcatactggttttcccagaaaaattcatttggtgaattgttcataagatgctgacaaaactggccccacctttgtgcagctggcagttttataccatagtaaatttcccagagtcaatgccaaaaattaaaaaactaaggtaccaccagctagtaagtgtggaattatacaatcaaagctgacctctcatttcctttttggaaatagttttcatgggataaatatgtgaatgattatattccaaaggcaaccaagacaacagtataaatgggcaatattatcataataacttctcaaaggcaggattgtctgctattcctaattcatctgatgagaggtacaccagtcgatacaacttttaatttctagtcctaaatcatttctatgaaataacatgtcaaagtaaaatgcatacttaatgagggccagcaaggggccaaatttgcagtatgactattttcttgaaatatcctcttggcagattgctaccaaagacagcaaccaatttgtaatgcaggatttgcttttagtgtaccaatctttacacattgagtaattccatgaagagaaaaggctgacttaaaaaataaataaaataaataaatcccatccttatggtttgcacagaacaggttttagttataaattcattccatttaatttttattgaattactccctaaaataaatgcaaacaggcaggtaccagtgagacacaagtataaaagggcacaataaagcagaatgttcaaagtcctgtgggtacatgtgcacaacacgcagtttagttacatatgtatacatgtgccttgttagtgtgctgcacccagtaactcgtcattttttaaaaatctttgtccttttctcaaatcctccctccaaagtccaaagtttttttttacattagacctatagacttttatgaagaaattcatttcaatgcagccaagctaggctgggaatgagaacctggtttaatataaaagtatgcctggaataaaatatcatcctttgcctctatctatctctatatcatcctacacaccataataaaacaaatatttggaaataatctagttatttcctataataattcctaatgatttacagtatcaagtcctatatacttggttttcaaattcctccataatctagttccattatatatcctaattccaaataatgcagaaattatactgtctcacccaatgaaataagattttaaataaatatacattgtttcagcaaacaattattgggtttacaatgtgtcatgcaatgttcatgtagctgaaatattttcacatatatatcaggcttttcctatgccctcaacatgtccttcacgatgtccttcctatatagttcagcatgaggtattcgtctctactctgtcaatttctgttaaattcatagtgaactcaaattaattttaactcgagaaatgccagttagagaaattaaagcatgatatataattacaccgaggaaccagatttagaaccggagaagcattgtttctcaaggccgttcttgtcttcatatttcatggtcaaaggtcaatgttgaaaaagctgatgaaagctaatagtaaaactctcaagtctgtacccaagcaaagcacctgatcagtatctgatccaagcaagtcaaaaaaggaaagaagtttgtgtgtaacttttggcttcagactgatatgaaaggcttcatcctttcaattaaggcatagacttttgcctatctgtgatataaaatatattaacagctatagactaggaatttttacatttaagccaaaatacagccaacagagtttaaattttaagtaatttgttaaactaaattaactgaattttcaattataggttttaaatgcttagaaattttccatacgtttgttatagacctcttgttattttctagtttcaaaaatgtgtctttgcataaactcacggttttcaggtttttcacaactgcttcaataagcattacagtaatgctttttaaaacgaaacgatttcctttgctatattattgcccagttgacgttcttatccaaagccagttttgctctctgaatttacttttttctttcttctccccaaaggtgtattgatatgatacacactccttccatttcctggtttaatttgaacatgtcatcctcccacatcataatccagtccatctaccaacaacttatttttcttctgtgagactggcattgatgatggagatcacagggtttaggatgtctcttttcagttattgagcctggcccattcccagtcctaatctttttcttgttaaaaatcaattatacatatatatatttttattatactttaagttttagggtacatgtgcacaatgcgcagtttagttacatatgtatacatgtgccttgttggtgtgctggacccagtaactagtcattttttaaaaatctttgtccttttctcaaatcctccctccaacaacaggagacagctttctttaaatgtccctgctccgtcaccattttctgtgaacaagtctctgctccatcaggatgcacaacaactacccagacccatgtagtgacattccaaataagcttctctttggtcttggagccaaagaaccaagtcctaattcccaatttctcccaaactttcactatctcagtgtattctctcttctcactcttatttctatcaagacacctatgaatggccttctctttcattgaacaacagttgattcagatacaatcaattcaataactctcattttagatcagaaacatacatttatgtttagaaaagactaatcaattgagtacctaagaaaacaaacaaggagctaatttaatgtcctgttcccaagagcactctcacacagacacagaaacaaacatacactcacacatccctacacaccaactgttttactaaaatccagccacactaccttttttgtcttccttcatcaggccatgcttgtttggggcttttgaacacgcttttctacaaggctcttctcccagatcatttcatgatggcttccccttctcatcattcagtcctcaactcaaatggcacgtggttactctttatcccactatccaccctatctgacccaagtcacttttgatcccactgcccagatttcttttcttcacaggatatcactatctgcaactattttacttatttataaactgactcattgtcgattttcctacattaaggaggctatctgtcttattctctgccaaatcacttgcccctaggtgtcatgcctggcacatagtaagcactgatagatctgagtaacgaataaatgaatttacagaaatcgttagccataaatagttttcaagtgcttacaatgtgcaaggtagttcttttttcagttgaatcctaggatgaaaaatgctctgtctctcagcattaatggggcacagtaagtccatttaagagataggtccaagatcaagtggatgaagcttattttgaaaaagttctaaacaaaatatattcctaccacattagacctaaaatgtattaatacataagattaacaacattgttcttctcagctattgtttccttcacacttccccattaaacttttgatatgtcattatgtccttttatgatgtcaaaaacaattgaatggaactgaatgaaagtagttacaacgacacatacccaatttgggacctttactgccaaaatagatgggtcaaaatgatgaaacatggtaagattcggggtgagaccaaaccctgaatctttacatgttcactccctcccacattcatacaatgtacaaatatcctgactatacctagccttgacaagcgttctaatgcctctacaggtgaaaacatccattcatttaaaccaggacctttatctataaagtgccaaataataaatattttagcctttgcaggtcataaagtttctgtttcaactactcaattctgctactatagtctgaaagcagccataagcaataaacatataaacaaatgaccatggctgtactccaataaaactttgtttacagaagggggtgggatgcatttggcaaaccctgatctaacccatcagtgaagcctccaaagtttatatatggggagatttagaaagaaaatttgatcagaaagtgtgttaggaggacttgtgttagaatctgcttttctgtgatacacattttgcttttatatgaaatatatgtgtatgggggggttggaaaagattacgggaaaactgaacccctcaggtcactcttatcactgccgcctaatcctgcaatccatttgagggtgttcttggcattacattttggccttctatagattcatcagctttctctgcatattttatccatcagattatttatatcgtaattctacaattatttttgaaaagctacaacaaacactcggttgaagttcaaaatatacattccccttaaccatgctaattctgcattctatttcaaacattattaattttgtcaggcaagatttgtttataataaactcatttttttcatcgctcatgattcctttgtcttcaagatgtttactgatttctcttacaatgttttatgagaatgttgtcagataccctgtaagccattcaacattacatttacatctattataacaattctttctccctcaaaatcttttaggtcttccaaatttcccaattggaatatacctttatccaaagtataataaatacacctttacctgtttctggttgatagctactttcaaaaggtattttaaacgcattatatgtttttcaaaattgtgttttaacaccaaaacagccacacaattaaactaaaatttagtaaagattctaaatgataacacactgtcataagatacattacatattaattagcaatgttatcattttctattctccatcttatagtttctgtaataaatcctactgccaatcagctttcattatcagcccgtctaatcatgataaccaataaattgtactctatgcttctgacatccaattctgctttatctattctagctatagtgtcaaaatatttttgtagcttcaactagggtttgacaaaaatgctaaaactataaaatctaaatgtaaagtttaccattaaattatatcagcatgtcatacaaccatgatttttaaaataaaatgagaaaatacataaagtaagattttagataacatgataaagtctgcttcagtttgattcagtattcaataaataaaaccacttgagaatcccagtaaaagtaaaccttgagatggttgaaatatccattttaaataacgggaacttttaggtaattgtctctatgaaacaagaatcaggcttttgaggtcataaaatgcttgaccttcccaggtacaatgaatgcagaaagcttactactaagttacacaataggggtaagactgttgaatctatctgaaaaattacattttcaaaagctccacaaagtaactgattcattaaagaaataattggaaagattctttctctttcctcatatgaaggagaaatcacaaaacgttgcaatattttcaaaagaggatgaagtgctcacatttcacttgtgaggtttcaatagctttattacctatgctcttgctgtttgttcagcatgctgaagaaaagtatttccaaaataacataggtttgctaatccttggttcctgataatatcacatgataggataggagctttcaaacacagtcaagctgacagtcacttgctctgtactcagagggaccaatttctccctgtagacatgaatacagcacaaataataaagtgccaaaagttgagtgtaagtgcaaacccttcaacatcactcaggtatcagcaaaaagtacctgtttagctacatgtagaagtcaggtacaacatgttgaaagggagggaagattagaattgaaataatttatctgcctctgctagtttatctgcatcactgaaaagaattaaaccaaccttgccaaaggtaagtcttgtctaggtacaaactgtcttatcaatgccatctcatctattccctatcgtcttctttttttttctttttttgaaagaaactttttatttattgtttttttcacattgcaagtgatggtatccagtttctttttttttttttttttaattatgctttaagttctagggtacatgtgcacaatgtgcaggtttgctacatatgtatacatgtaccatgttggtgtgctgcacccattaactcgtcatttacattaggtatatctcctaatgctacccctccctcccccctcccccaaccccatgacaggccccggggtgtgatgttccccttccggtgtccacgtgttctcattgttcaattccccacctaagagtgagaacatgcggtgtttggttttttgtccttgtgatagtttgctgagaatgatggtttccagcttcatccatgtccctacaaaggacatgaactcatcttttttatggctgcatagtattccatggtgtatatgtgccacattttcttaatccagtctatcattgatggacatttgggttgattccaagtctttgctattgtgaatagtgccgcaataagcatacgtgtgcatgtgtctttacagcagcatgatttataatcctttgggtatatactcagtaatgagatggctgggtcaaatggtatttctagttctagatccttgaggaattgccagactgtcttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgatttgcatttctctgatggccagtgatgatgagcattttttcatgtctctgttggctgcataaatgtcttcttttgagaagtgtctgttcacatccttcgcccagtttttgatggagttgtttgttttcttcttgtaaatttgtttgagttctttgtagattctggatattagccctttgtcagaagagtagattgtaaaaattttctcccattctgtaggttgcctgttcactctgatggtagtttcttttgctgtgcagaagctctttagtttaattagatcccatttgttaattttggcttttgttgccattgcttttggtgttttagacatgaagtccttgcccatgcctatgtcctgaatggtattgcctaggttttcttctaggatttttatggttttaggtctaacatttaagtctttaatccatcttgaattaatttttgtataaggcgtaaggaagggatccagtttcagctttctacagatggctagccagttttcccagcaccatttattaaatagggaatcctttccctatttcttgtttttgtcaggtttgtcaaatatcagatggttgtagatgtgtggtattatttctgagggctctgttctgttccattgctctatctctctgttttggtagcagcaccatgctgtttggttactgtagccttgtagtatagtttgaagtcagttagtgtgatgcctccagctttgttcttttggcttaagattgtcttggcaatgtgggctcttttttggttccatatgaattttaaactagttttttcccaattctgtgaagaaagtcattggtaacttgagggggatggcattgaatatataaattacgcaggacagtatggccattttcatgatattgattcttcctatccatgagcatggaatgttcttccatttgtttgtgtcctcttttatttcgttgagcagtggtttgtagttgtccttgaagaggtccttcacatcccttgtaagttggattcctaggtattttactctctttgaagcaattgtgaatgggagttcactcatgatctggctttctgtttgtctgttattggtgtataagaatgttcgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctgtatttatttctcctgcctgattgccctggccagaacttccaacactatgttgaataggagtggtgagagagggcatccctgtcttgtgcccgttttcaaagggaatgcttccagtttttgcccattcagtatgatattggctgtgggtttatcataaatagctctcattattttgagatacatcccatcaatacctaatttattgagagtttttagcatgaagggttgttgaattttgtcaaaggccttttctgcatctattgagataatcatgtggtttttgtctttggttctgtttatatgctggattacgtttattgatttgtgtatgttgaaccagccttgcatctcagggatgaagcccacttgatcatggtggataagctttttgatgtgctgctggattcggtttgccagtattttattgaggatttttgcatcgatgttttcatcagggatattggtctaaaattctctttttttgtggtgtctctgccaggctttggtatcaggatgatgctggcctcataaaatgagttagggaggattccctctttttctattgattggaatagtttcaggaggaatggtaccagctcctccttgtacctctggtagaattcggctgtggatccgtctggtcctggactttttttggttggtaggctattaattattgcctcaatttcagagcgtgttattggtctattcacggatttaacttcttcctagtttagtcttgggagagtgtgtgtgttcaggaatttatccatttctgctagattttctagtttatttgcatagaggtgtttatagtattctctgatggtagtttgtatttctgtggaatcgatggtgatatcccctttatcattttttattgcgtctatttgattcttttctcttttcttctttattactcttgctagcagtctaccaattttgttgatcttttcaaaaaaccagctcctggattcattgattttttgaagggttttttgtgtctctatctccttcagttctgctctgatcttagtgatttcttgccttctgctagcttttgaacgcttttgctcttgcttctctagttcttttaattgtgatgttcgggtgtcaattttggatctttcctgctttctcttgtgggcatttggtgctataaatttccctctacacacttctttgaatgtgtcccagagattctagtatgctgtgtctttgttctcattggtttcaaagaacatctttatttctgccttcatttcgttaggtacccagtagtcactcaggagcaggttattcagtttccgtagttgagtggttttgagtgagtttcttaatcccgagttctagtttgattgcactgtggtctgagagaaagtttgttataatttctgttcttttacatttgctgaggagtgctttacttccaactatgtggtcaattttggaataagtgcgatgtggtgctgagaagaatgtatattctgttgatttggggtggagagttctgtagatgtctattaggtctgcttggtgcagagctgagttcaaatcctggatatcctttttaactttctgtctcgttgatctgtctaatgttaacagtggggtgttaaagtctcccattattattatgtgggagtctaagtctctttgtaggtctctaaggacttgctttatgaatctgggtgctcctgtattgggtgcatatatatttaggatagttagctcttctttttgaattgatccctttaccatcatgtaatggccttctttgtctcttttgatctttgttggtttaaagtctgttttatcagagactaggattgcaaccactgcctttttttgttttccatttgctccgtagatcttcctccatccctttattttgagcctatgtgtctatgcacgttcttatctctctttctctcctaaactttttttttgtaataatctctctctccacctaaacttttcaacttctctctctttctgtcttttttactccctccactagacatacccactctctctcacaaataaatactcactgtatgatgctaactgctaacttaaaggagatgtaattttatcactcacatatgattattgatgtgaaagtgcaagagtaaatatgtcagcaactgaaaaattagggcaacatgatccaaatcaagtgctaaatatattaatcatatacatactatgcacttctatagaaaaattattaggctataagcaatcataaagattagcataaataacctaaaaaaactattaaaagtcaagacagggagattcagctgacagagttgtatctctctttcttttcatataaagagatattcagtatgatgttgctaattaagaagtgaaacaagttagaatgaaagctataaagggaaatctctgggtgtcagacaaaaagaaagaactcaaagccagagcagaaggtggggctgaactcttggtgtccccctagagcaccatagccacatatatccatatatttgtccgcagtgtggggaaacagacaaagcctgaagccaatgagaggagtggaacagaagctgagactcccacttattaatggatgtcccctcacgcatctgtaagatttagactagaaaagtctataggtctatagactagcccagagacagagtaataaaactagaaatcttcttagggttctgggggaaaaaaaaacatagaaaatgaaacccagatacgtgccatgagtgccttaggaatcagcattgcattatttgggacagaaaactcaaagctaaaaattaacacaaaaccaattaggttttctgtagaccagtacaggcacagatcatgggtcacagaatagaaggaaatactaaattactttggaaggacccaaggcactcacagagaaaacaactttcttcacctgagaatgagctaaccataggatcaaaaactgatactcttttgttcaattcaacatctacctattaaatgcttttttaggcagataatattttagaccctgaagatatattagtgaataaaacataattcctgtttatactctcatgaggaagacaatgaatacagaaatataaaatataatgttcagtactaacaaatgccacaagagaaaagcagtacaaaagaaaatagaagaagagatggagaaacagatatgtagaaaaaatatttatagaaagactctaagaaggtgatatttgagcagaaccctgaacaaagtaaaggagtgagtcatgaggcagaagatacatcaacaggaaagaatacaattagtaaagatatagaagatttaaattacatcattttgaactaactgatgtgtaaaaacttcaccttttgaaaattgcacattctttccaactaatgtgtaatatttataaaattcaaccattatgatctaaaaagaggtgttaacaaataccaaagaattggtattacaaaataaggtatctgaccacaatggaataaaataagaaattaagatgaaaagatagattaaaaagccctatatatttagaaactaaaaaaacattcataaatattccatgagtcaaagaagaaatcataattgaaatattaattatttaaaatgaacacaataaaggcactacatatcaaaacctgtgggatgcagctaaagtggttcttagtggaaaatttatggctttaaatgcatatattagattttttaaatacgtaaaattaattagtttaggatctcacttagcaagttaaaaaataatagcagaataatccatgtaaaagagaaggaaagaataatgattagaacaaaaattaataacatgaaacaaatgtacaatagagagtatcagcaaaaccaaaatttgttctttaagaagaggtgtaatatattaggctaaaccatattattttttcagtattcaacccatagtaaaacttatgctgatcaaaaaatattaatcattaaatatttaagaaagaaaatagaggcactgattagaaactttaggaataaagagaatgtatctcaaacaatataggaaagatttaaaataacctgagaatatactaaacaactaaatggcaatcaatttacaaactcaaatgaaataagcagtttcctagaaacatgaaatgtaagaaaaatatgtaattagaaatagaaaacctgaataaatttatgatcaataattgagagaaaaaataatctcctgacaagttacatctcacatggtttaacagttgaatcctgccaagcctttaaggaatggataatcgtagcctgatataaactattacagaaagaaaaataaatatccaaacttcactgtcttcttacttttttctcagagcacttagtgtcttagtaatattttcacaacaaacttagcttaaaagtatgtaacagatccattaatttagtacttaggtctaaacaattaaataagtatttttgtcccagcaatacagccatatagaaataataaacacaaatttttaaaaattatttttacttcattcttatatagccatctttaagtttattattattgggatgtgtgtgcctgtcaggcactgcacaacttttcaaaccttgaaatctgattggacactgccacacttatttcctgttctatattgattttcatgcagtacctgctttctatgacagcaaccacaaaaaccaagcttcacgaagacatgacaccatcaggatgaatttactgaaatcccacgctaaaactgaactattcagggtagtgtctgacctggtgtctgacagatgttgaatattgctacgtttctcttaaaaattttaaatagctcatggcccacctgtgagttcactgtggccctacaggagtgccttggaacatagattgcaaaccatggcattatggtgagaaatgacttatgtaaatttttaagtaaacaaaactgcaccgaatgttcatggataagtgtgtgcgcatgtgctgcatgaaatgaaatgaaaatataaaaatagtaaaaatatgaactgaaagcatatgcattaacttcagaagagtggttacctctagggacaaaaggtggaactgtaaacacaagggaacttcaactatttctgcaatgactaatttctgtaaaaacaaaattcaagcaaatatggcaaatgctaatgtttttaaaatatgggtgatgggtatttggtatttattacattaatttcgtgccttattatacttttgaaatagttcataaaagaaaataagaaatgacaagcattgtgagttttcaaaagcttcatataggttgctacttttagcatgccattctaaatcccaggacatctggttactgttagacctgcttttctagtttccatttagaatcattaaactatccattcagagtagtcttaacatttaaagacaaaaaatcatataaagacccctatttcataagcttcaccctaagtcacaaatgctgcttttatttagtaactttgaaaaaatctcagcagaaatcagatataagtgctttctattcacttcttcaaaatatacttattttctcatttcagttattgaaaataataccatagtatgatagaacataacatgtattcatttagtgctatcccaaaccccacaaatctctggtctattgcaagaaatatactcattttcaaacttagtattaatatatttattttgtaggatactaaccaagtcaaaaatgaaactacattgaattaactgatgattatgccagatgtacattaagtttgtgttagtcacgtatgccagttcctcacatccatctcccctttaccttctcccaaccccaacttttcaaaataaaattaatattattcattagaagcaggaaactatagagggaatgtcagcaaatgtcagaagttccatgtatcagtcaaggatcaaagaagttccacaataataacatgagctacaataataaagtaaataagatagcaattatcccaccttactctgaactggccagatcatggcacatgtcttttattatgaggacactgccttatcaaaaagcctaaagagaaaaacatgtagaatggtgagaaatcttatttttttcttttcttttttttattattatgctttaagctccggggtacatgtgtagaacatgcaggtttgttacataggtatacatatgccatggtggcttgctgcacccatcaacctgtcatctacatgaggtatttctcctaatgctatccctcccctagcctcccaccccccaaaaggccctggtgtgtgatgttcccctccctgtgtccatgtgttctcattgttcaaatcccacttatgagtgagaacacgtggtgtctggttttctgttcttgtgttagtttgctgagaatgatggtttccagcttcatccatgtccctgcaaagaacatgaactcatccatttttatggctgcatagtattccatggtgtatatgtgccacattttctttatccagtctatcattgatgggcatttgggttggttccaagtctttgttattgtgaacagtgccacaataaacatacgtgtattttttataacatacacatatgtctttatagtagaatgatttataatcctttgggtatatacccagtaatgggattcctagatcatgtggtatttctagttctagatacaagataaaaacaaacaaccccatcagagagtgggtgaaggatatgaacagacatttctcaaaagaagacatttatgcagccaataaacatggaaaaaaaagctcatcatcactggtcattagagaaatgcaaatcaaaaccacagtaagataccatctcatgccagttagaatggtgatcattaaaaagtcaggaaacaacagatgctgaagaggatgtggagaaataggaacgcttttaccctgttggtgggagtgtaaattagttcaaccattgtggaagacagtgtggcaattcctcaagaatggtgagaaatcttaaacagtaggggcagttgaggcaactagagaggtttaacttggaaaacagaagacaaagagagaaatctccagtatcaccatgtttttggtagagtattatgtggagagataatcaggtagttacaaatcactggaagacaagagcatggatctccaggaatgactgctagatccacagtgtagaacctttggggtgattaaaacgttctggaattagatagtggtgatgtttgtacaaccttgcgaatatgctaaactctattcttgaaatgtgtgaaattttatggtatgtgtaaaacaaatttttaagtgtccattagattcagtaacatgattagtataatccaaataatacatgaaaagtcaaaaagcaaacaataaaaacaatggtttccaaagaaataaagtaatttttcaagacagattgaaatgttaggaaagagttttctttttcttttctttaaaaaaaaaatagtgaagggcttgaacaagttcgaatgttgataacaaaggagtttacaaagagacaaagcatgaagacatagaaaagataaaattaatcaatactgcaaaatttctaaaaaagtagaattagtgttcaaaacataggtaaacagattagtctttttaagtggtaggttaatttctttttacaaaacttcatgaaaagaggataccactagctagtcccacccagctgacccaggatatttacagattttatcttgggatgttaagcatgtacttagatggatgtgtctacttttttttgactagatgataatgtagtctgctggggagaagaaggagcaaaggtagaaagggtaaataatttgttcaacattagccagctagaaatggatagatttcatttttgaaatcatttatttttttaggatatatttaaggtgctcagcatgttttgatataactataaatagtgaaatgattactacagtcaagcaaattaacttctttttattttgaagtgattatatacacacatgaagttgcaaattagtatagataggtcaaatttacccgttacccagctttccacattggtaccatcttacataaccatgtacattatgaaaatgaggaagttgacctagtacaataaaataaacaacaaattttatttggatttcatcaatttgtgcatgcactcattttttgtacgtctttgtatcacatgtattgatataaccaccaaaaaaatcaagatacaaagctgttgtgccatcacaaaagaatttgtgacctctttatatgcctgaccttctgaaacctctgaaaataactagacttaatcataagagtaatgggaaactactgaagagtattaagtgataaagtcacatggcagactgtttcatgtttccctttatctcaaataaaaacaggggtgcataactgaagaaagaagaggcattagaatattatttcaataactaaggtaaagcatgatgatgtagaatagaatagtgactctagatatgcagcagagtggataatttcaaagatgtagattcaaaagaatatggtagttaactgaatgtggtagtcaggaagggatcaagctgagcttacctgacttggatatctgggttggtggtaatatcattcacagagatgtgaatcatgagagaagtggcttggatgtgctaagtttatttctttatatgtcaagttacttatgggttattcaaatgaagatgtctagaaggtaatttggtattggagtctgaggttcaggaagaggatcttgtttaagataaagatgtggctgtaattgatccatatatagtaactgaagccagaaaattgggtaagatcaatcagaatatggtatcatcgaagtcaagagaaaagaatgaggatagtggagggaaaaggaggggaaaggaggggaggttggggaggggaggggagggaaaaggaggggaaaggagaggagaggagagcagaggagaggagaggagcagggaaatgaaaggaggaaggaaagggaagggaaggggaagaggaagggggaaagggagagggagagagaaagggaaagggagagggaaaggaaaggaggaaggaaaggaaaggaggagggaaatgaaaggaaaggaaagggggagggaaatgaaagcaggaaggaaaggaaaggaggagggaaatgaaaggaaaggaaagggggagggaaatgaaagggggagggaaattttcagggcaaaacagaaagaatggaaggacagaaagatggaagagaggaaggaaggaacttgcacaaattgagggcacatgtaaaaacttcaaatatcatgtactcattacatataatttgtgctatataaaacttaatgcaaacttatcagcttttctttctttaaacctactttttttttacttactgtttttccctcgaaaagttctttattcttagaaggaatttcctcaaatatttatattcgataccaatattttttctaaaatgaaacatctctattttcttggcccaagaactgtggtaactagcttgaaaacagtgctatatatttgttatgtcaggaaaaatatagttgaatgaagtgttctctttcccataaagaaaaaagagtttcaagctacatttaagttttctttatactaccacctctccaagcgtttcagctatcattgttttttaactgcctctataatatacaatatgcagccaaatatttggagatattttggtcaaaaggtatgttagcaacaacaatagaaataataaaacaattctcaatgataactgaagctattgcataatttaaataaaatggaaaaagtcagcatcaactttgaattcattggcctttgtcaatttatgttgcaatgttatatttgtttaaggcataactctgaattcatttaatgacctagactatttagtgttggactttcatttaaaaaaaaaatagcaaaataaaatgccatctcgtagagtgctatttaccatatgagatccatctggcaataccatctaatatttaactttgaaggcactgttatcaaatagttgctctaaagtgcttataagaggcaaattcttctggtttttcttctaaggcatattatattactgataattttaggataacagatctgaatgtagatgattttaaatgttgattacagcacattatttaatattttaaatattgactaattcatttttaaattatttgtaaattagcagactatttcttttataaaattaaatattttgtattctcccaccccaccgctagaagtctttaaggggaatattataattttaaaataaaggatttaaagtaacagtttcctgttagttttgtggactgttttcttttccagtaatattttgagtccagttcaccataacttaccaataccctttcacattgcccaacccctagaaacacttaacagatttttctctccataggttggctatattcaaaagaaacattggcctatcaggacctctcagtatccatgttgtggacaagaccaaagagaacttaacactttgaaaacagctactttaccttatgtgcgactcataaacatttaactcagtgttactcagtgatgtgctgccaaaagtaatttaccaggttccaaatgctatatatctggataaactggtctccaaaagcaaacaaacaaaaaacctcattatatatttttaaagaaaaatgtggcccccactactaggtcagcagagaattctgagaatatataacaagtcctatgacttcagtcccaaaagctctggcacaggaaaacactataaacttcttgcaacaagagaataccatcaatactagcagggacatgcttatgtctacatttaggtgaactagcaaaatctttcatctgatatgtactaaattcttgaccattacgaggaaaaaaattatatctgaagtggcatattctaaacctgatgaatttcccacaaatcaaaaaaaaaaaaaaacaaatttctcacaagttaaaaaaaggagcctatatttcaaactattacttgtattgtaggcttctgaacaattttattatactcttcagtgttttccaggtttgttaaaataagcactttaaaaacaggaaaaaataagtttgaaaagataaattctagcactctattcctacaagataaagaagtcagattactcttttatatccaatggaatacatgaattagacttataagatggttggaaacacaccacaccacatttaatacacattccagaataaacttcaaataaaaatatgagctgttgaccaatagcagtattataaatttaaaatggggagctttttttaaatcacatattaaaaaagaagaattgggaaccatgtggaagcaaagagcaatttaatatacatacacaagtttagggattttttttttaaagagaaattgagagtcaggcattaaaggtatacaaaatttgtgtctcaatatattaccaattaaatattgaaatgtaaaattgaaagcacaacacctacactaaaaccaaaaaattaaataaattcttcatataaaatctaacaaaatatgtataagatctattatgaagaaaactacaaaactctgatcaaaggtatcaaaaaagaactaaataaactgagagatattccatgttcatggatagtaagactcaatactatcaaaatattacttcttcccaatttaatttttagattcaacataatcccaatcaaaatcccacaaagttattttgtggatattcacaaactgattctaaagtttatatggagaggcaaaagatctagaataggaaacacaatattgaagaaagagtcagaatgctgacactacccaaccccaaggcttactatatagctacatgagtcaaggtactgtggtatttgcaaacatacaacttagatcaatggaacagaagagagaggccagaaattgacccacataagtacagtcaactgttctttgacaaagaagtaaaggcaatacaatagagcaaaagtcttttcaacaaatagtccaataactgaacatccacatgaaaaaaaatctagacactgacattaaattcacaaaatttaactcaaaataaatcatagacctaaatgtacaatgcaaaactgtaaaacttttagaagataaataggagaacatctagttgatcttgggtttggcaataaggtcttagatataacaccacaagccagatttatgaaagaaataattgacgttagagtttattaaaattaaaacttccatatttgtgaaagacaaatcacagactagaagaaaatatttgctaaacacatttctgatattcgaccgtcatccaaaatacaccaaaaactattaaaactcaagaagaaaaacaacttgattaaaatgtgagcaaaagatctgaacagacatctcaccaaagaaatgcagatgaaaaacctgcatagaaaatgatcaacataatatgccattagagaattgcaaattaaaacaatgagatatcactaaacatctattggaacggctaaaactcaaaatactggcaacaacaattgccgtcaaggatgtggagaaatacaaactctcactcattgctggtgggaatgcaaaatgctatttggcactttcttaaaaaattaaacatacacttaccatatgatctagcaatcatactcattggtatttcattgaaaattatgttccacaaaatcctacacataaatgtttatagcagcccaatttataattgcaaaaaaattggaggcaacgacgatgtctttaagtaggtgaatgcatgaacaaatttctacatccatacaatggaagattattcagcactaaagagaagtgagctattaatcatgaaactatacagggaaaccttaagtgcatactgctaaatgaaataaaccagtctaaacagctatatcccgtatgattccaactatatgacattctggaaatggcaaaactatagataccgtaaaaaagatgccagggtttggaaatggggagggataaacaggtagagtacagaggatttctatggcagtgaaagtaatttgtatgatattatgatggtgggcacataacatcatgcatttgtcaaaatccattaaatgtacacccagtgaaccctaatgtactatagttataataatgcatcaatattggttcattagttgtaacaaatgtaccaccatagttaataatggggaaaagtggggaggagaagggtgaatgggcatacaggaactctactttctccccaggttttttttttgtttgttttttgtttgtttgttttttgtaaacttaaaactgctacaataattaaaggctattgttttagttaaatccatttatttctaaaatttaaaacaggaaacataaaacaactaagtttaagaagctgagtgtggtgatatgagcctataatcccagcaacttgggaggctgaggtgggaaaattgcttgagctcagaagtttaaggttagcctgggaaacatagtgagcacgcccctactaaaaaacaaaacaaaacaaaacaacaacaaaaacactaagtttaacaaatattatgtttgcaagtgtcaggtgacaggcatgtttcatttttttcaatattacctgtctagtgaaatcaaagataaatatgtagctgaattttacttactgtgaacaatcaggtggtttgaatttctcttttcagcagtagaaacaaacgttttggaaatcaatatggatttttaaaaactccaaaaaacattaatttgtatttattaatattatgtcttcattattatattgtcagaacaaaaggattcaggttatttataaaatttttaaaatgtgtgtttttatctaggaatatagtcattttaaaattaatgctactgtcaggatgaaggcagggagctctgatacttttcaaaccacctattctagcacttgagatctctgcagaatttgggcctatactgtcatgagaacttgggatttcaatagatctgctcgtggtttcaatctctagttggtctgcaaagaaattaactctgtgctactgcccaaaactatcccccaactttcaaggtttcctgccttgaaaacatgcacattttgtcctcaaaagagtacagaaaggtacctataaaacctgcactgctatggtctaaaatgaccaaaaagatgccttgcctataatctccgtatatgcaagactgaacattacattacatggaagtattctgtaaccaagagtctttgcctttaaaacaaaatatttttttttccttagaggatagctatttggggacttagcaaaactggacaactctcagaaacaagtttttcttcagtagaacacacactagggtttgtgcctcttttctttgttcagttttatacatgtataaaggaaagacaaaaaacaagagggtctttcatttttccacagttccctttcttgggtgccattcctctcattgttcatagatgaatattcagcgtattcttctcacacagaacacttggccagttttttcttttgctctatattaaagggcataatatttctttaactgaggaagacatatttataatataattttggattaagatttttatttacaaatcatttcatagaaagtttctctaaatttttagcaagagatatttggctataattggtcagatttatctgtcttcatttcaaggatctctatggtactgaaatttctgtttaaagaattttaagtaagttcatttatatacagttcatgcaacttatttacttatcccccttcaacatgccagccatttctttccaaatgttaaacagagttactaaaagttatgtgtgtgtatgagtgtgtgtatgtgtgtgtgtgggcctgtttatgaaggagaagcagagacagagggaaagtgggtagtcattgtattcaagccaacaaccccatttcaaaggagagggattcttaccctgaaaatttgttttcaattcttcacttttaaattaatacatttagaaaaggtttaatagaatgtggctgaacctcaattaaataaaaatttccacctcttgattttatttttttgttgtaattaattggtcattgggtttatctgtatacattttatctgtatttgtatttattgtatgtgtatttgtatttatttgtataaatttatctgtataaatttttaatgaccccaaatatatcatgaaaacatttaaatgttttcctttatctaggaaattatacacatgtttgaaaaccaaacagtttatatctgactagatgtttagttgctattactattttgaacttggaatggacattattttaaaataagttatttgtaaagaactgagatttactgcatcctaccttatgtcaggtactcatgtcttgtctcaaatcatgttctgaacatctctttgcattaatataattaatcccagtttacagaagacaaaattaagaaccaaagagagagagtaggtaacaatcaaggtgattcaggacttaactgacaaatctatcaacttctctctacctctactgctgccttcttagttgaggtcactgtgatttccatcctggaccactgaaccactgtattcaccttctaactggattcctcactaactgccttgataattccaatccattctgcaccagaagcaggtttattatgggactgtgtcatacttccctggcttcccatttcatttagggcaaaattctatgaggtctgtctctccatttctctttaacttcatttcaatctactctctttttagctcacagcattctacccacgttaatgtcctttttgttcctagacattgccaaatgttttttttttcttttttcttttttgttattgctttctgatctactataaaatgcttttcttctatggaggcttcaaacatcctattccttgccctggatttctgcatcactggatccttcttatcatttgagtctcaacagaaacaccacctcttaaaatggtcaccctctgattcttgcccagacctttgttagttactgtcagaaaaaaataacttctttatgtacaatgaactagtttgcttgtttgtttgtttgtttatcatctattcctccactccctctccattccccctccatagtaggacaggaatattctattttatttactaccctcatatagtttctagcacttcgggtactgaataaatatttgctggatgaatgaagtctttgttttctccactctaaaatgtgctcatattaattaaatatagtcataaaatttatccagttggatatatatatatatatatataaccatttgtccttagtaaagcttgaaatatgtgaaatcatggcacttcttttttttcccctgaatattatttcttggtcagaacattatcttcctccttggcaaaaatatattgtgcctttatgttttagcaaagtatctcaaagaatcatataaccgtagcaaaatggagctgaagggcaccttagagcccacctacccctatcatgcacctggcacctgagcctcttctacagcatcaagtggccactgagacataccaggctggaggaactaagtaccttttaaggcaacacatctaattcttagtgttttaatagcctaatatttgtttagcgttttggtactaatacattccaagtttctgctgtctactgacttttcactatttgttcccttagatattcatttgaaatctttttagtttaacctgatttagctgtttctttttattaaaaaaaactcgaggtaacttcttttctgatttaatgtagcaataccagaaaatcccttttgagtttagtctttcagattgttagtaaacttaatgatgagaataggagtatttgttatttttctgcaaaatagttctatctatatttctttctacttctcattgtgcaaagtctgttctttcattaagacactgtaattacattatagtcagtatgttttaagtaaaattctgagattcctttactttttcttgagtcgtctaaaaaaatatgttttgataaaatcaagtgaaatatcctttatgacttcaacttcttctggaaatacttgtcctctatatattttatcacttaatttgccaattatgtctactccttttgaataaggaggaaataccattttctgaaataaaaaaaagagaaagagaaaaaacagaaattagagaatattttaaacaatgtgttttatgtgttttttaaatgtcatcaaactcattcttcaggactttactcataataagctgttcaatgaatacttatttaacaatcgctctgtgttctattacttatccctttttctcacttatatgctcaactttttattctttataagttctttcttcttagcatataaacatgcatgattatctcccatcaaatatacataaaaataagcatacaatagaaaagaaagaaaatccttttttgaagatttgctctgttaccactttcttctctattatttctagtcaaatctttgaagagagtttttacttctttacccctcatcctgtttacagtccactgaaaactgacttctgcccttataacataatttaattattcccaccaagatcgcaaatcacaagacggtcaaatccaattgaatatattttgacttgaccttactttatatctcagatgttttgacattcttgacaactcctttctttcaaaaacactgtcctctcactggcttcatactttttggctcttctcctgcccttttctcttcctttgcaggctcttctgcttcttcttgaccctatatatgggttcttcttctgctttccaacagtctcttgctctcacatcatccttttccttgagtgattatattcacatcttcaacttcaaacatcacctttattttgatgactctcaagtctgtagctcctgcccttatcacagctcttctatatctctccagttgtatacatactgctgactatggaatatctttagctgaatgccccatagatacttcaacttatgacatatcaaactgcagtttttaaatcttcactccaaaatgatatttttctgttattcccgtctcttttaatggcactgtcatccaccaaggggatttggaagaaccttgagttcaagccctttcctttgtttccctacagttgccctgtaatctgtatgctgagggttaaaggcagggctaggagaaaatatgtttctattagatgagatgtatcatcaatattcaactggtattagaaaaataaccataaaaatgctcctgataataagcagctaaaacataaagaacatctttttgtaagtaatcgtgaacaatgtttgagagatagaaggatcattcaataatctaaaaattctaaacataattttacatatgaaaaaacagtcctagagaggaaagataaatgtctaatataaaagtaacttaatgaaaaagtgtggactaaaatctagatccacttctgtaagttttgtatttccttggtattagaagtaacttactcctccctgtccctgatctatgtaatggcaaacattttttcttggtaggagataaatcaggtcattacaagcatagaaagcaagatttaaacaaagtatatctgtaatacaaatttctgctagtagaatgtacctacattttaaaaagtgagagttctttctcagctgctttctaagtaatttacactatttatgctcccaccaatcctgtatatttcctatatgctcacaaaccatgaatattatctaatttgtaaaaccttgtcaatctgataaggaaacttagtatgtgtgtatgtaagattgaatatttttatacgttattggacacatatttttatgaattatgtttttagatcctttgaacattatctactgggttatttatatttcttgttcttgaattttcttctgtttcttggataatgttttcttctggaatgtattcttcaaatttttttaatgctatatatttttgttctgtattatttttacagttatgtcatctcatttgaatgtacaatcactatatagcccttaatctatatggttaaaaattgtgtgagtaaaaactctttgccactctccccaccccatctgaattcagattgacttatcctgtaagcttttattccaggactaaaattttgctttaacaaagccaataagcccaggtgcttagtttctcctacatacctattctcccaacaatgctttctcatcccctttcaggcagtgagaataaatccagtaaaataattacgttctatcacattattagtccagagctggcaagtagaggttacatatgtgcatgttcatgtgcctctacaccagcttcctcttcctgagatgactaggtatttactgtgatttgaatgtatccctcaaagttcatgtgttggaaactcaatctccaatgcaacagtgttgaaaggtgggacttttgagagatgattaggtcatgagggctccacactcttgaatggattaatgttatcacagcagtagctttgttataaaagcaagtttggctctttcttgctccccatttgatgagctctttcaccatgtgatgccttctaccacgttgggatacagaaaaaaggccctcactagatgcccaacacccttttatagggcttcacagcctcgagaacagtgagcaataaatttttctttatacattacccagtctgtggtattctgttatggcaacacaaaataaactaagacagtattatgtattttttcttttgttttacattttactaagtgccgacttattcgaaaaggtaattagctttggttaattatcaaagttttgtctttcctttcctacttttgtcccactaagcaaaaaacaaaacaatgagcattgacctttacctttctctggtaagggagtatggaaggttttctactactttgtaaaaatactgctacagatggtacttctggacccatgtggaacctgggggtccttgctgtcctgaagagaagtacacaggcctggctggcttttccacttactgattgtagaatctcaggcattgagcaaatataggcagtagccagggagcagttacatcaggccttaggtgaaacccactgctgtgctggcttcaggtctgacccaacacagtcatagtggtgatggccacaagggagcttgggttactccaccctgcaaaggagcttgggtcactctgagctttgcatagcttagagcagagaaagaaggactctgtattcttgggagaaaacaaggaaagagaacaagagtctctgcctggtaatcaagagaattctcccagatcttagccaagaccataaagcttatacctctataaatcagcaagaaccacagtgttattaggcttgggatgcccctaaagtagatatttcttagatcacaacattcaggtcttttcaaatatctggaacatctttccaagaagggcggctacaaataaacccagaaggtgaagactacaataaacacataactcttcaatgcctggacaaacatctataagcatcaacaccatccagggaaatgacatgacatccccgtatgaactaaataaggcaccagggaccaatgctggagaagcagagatatgtgtgacctttcagacagagaattcaaaatacctgtgttgaggaaactcaattaatttcaagataacacagagaaggaattcagaattttatcagataaatttaacaaagagaataaagtaattaaaaagaggcaggcagaaattctggagctttaacatacaattggcctactaaagaatgtctcagagtcctttaacagcagaatggatcaagcggaagaaagaatcagtgagcttgaagacaggctatttgaaaatatacaatcagatgagacaaaagaaaaaagaataaaaaacaatgaagcacacctacaggatctaaaaaatagcttcaaacaggaaacctgattattggccttaaagaggaggaagagaaagagacaggggtagaaagtttatccgaaggaataataacagagaacttcccaaccctagagaaatatatcaatattccaagtacgagaaggttatagaatgccaagcagatttaacccaaagaagactacctcagggcatttaataatcaaactcccaaagatcaaggataaaaaaggatcctaaaagcaccaaaagaaatgtaacaaataacatacaatggatctccaacacatctggcagcagacttttcactggaaactttataggccagcagagagtggcaggtaatatttaaagtactgaaggaaaaaatcttttaccctagaatagcatatctggtgaaaatatccttcaaacatgaaggagaaatgaagactttcccagacaaacaaaagctgagggatttcatcaacaccagacctgttctacaagaaatgctaaagggagtacttcaatcaaataaaaaaggatgttaatgagcaataaaaaaatcatctaacagtacaaaactcactggtaatagtaaatacacagaacaacacagaacattttaatactgtaactgcagtgtataaactgctatctcttaagtacaaagagtaaatgatgaaccgataaaaaaaataaatacaactttttgagacatagtacagtaagatacaagtacaaataataaaaagtttaaaagctagtggacaaggttaatgtgtagagtttttcttagttttctatttgcctgtttgtttgttcatgcaaacagtgttaagttgttgtcaccttaaaataattgcttataagatagtagatgcaagctttgtggtaacttaaactttaaaaaaatacaatggatacacaaaaagtaaaaagcaagaaattaatcatatcaccagagaaaatcatcttcacgaaaagaaaagaggaagaaaggaaagaaggaagagaagaccacaaaacaaccaggaaacaaaaaacaaaatggcgggagtaagttcttacttatcaagaatacattgaatgtaaatgaactaaactctccaatcaaaagacacaaagtggatgaatgaacaaacaaacaaaaaagatccaatgatctgttgcctataagaacacacaatacctataaagacacatacagactgaaaataaaaggatgggaaaagatattccatgccaatggaaactaaaaaagagcaggagttgctacacttagaccaggcaaaatagattccaaggatgaaaactataagaagagacaaagaaggtcaccacataatgataaaggggttgattgagcacaaggatataacaattgtaatataggtacccaacactagagtatccagatttacaaagcaaacatttttatagctaaagatagagatagaccccaatactataatagttggagactttaacaccccactttcagcattggacagatcttccagacagaaaatccataaagaaacttcagatttaatctgtgctatagaccaaatggatctaatagatatttacagaacatttcatccaacagctgcagaataaacattcttttcctcagcacatagttcatactcaaggatagaccatacgtcgggtcacaaaacaagtcttaagacattcaaaaaattgaaatattatcaagcaccttttctgaccacaatggaataaagccagaaatgaataccaagaggaattctggaaactatacaaacacatggaaattaaacaatatgttccagaatgacaagtggtaaatgagtaaattaagaaggaaacttaaagatttattggaacaaatgatagtaaaaacacaacatgccaaaatctatgggatacagcaaaagcagtactaagagggaagtttatagctttaagtacttacatgaaaaaatagaaaaacttcaaataaacaacccagtgatgcatattaaagaacttcaaaagcaagagcaaatcaaacacaaaattagtggaagaaaataaataataaagattagagataaatgagtagaaaatgaagaaaataatacaaaagatcgctaaacaaaaagttgttttttaaaaaaaggtaaacaaaattgacaaacttttagacccaaataagtaaaatcagagatgtaaaaggagacatcacaactgataccgcagaatttaaaggatcgttagtggctgctataaatagctatatagaaagaaatagaaaaatttggaagaaatggataaattgctagacacatgcaagctactaaaattgaaccaggaacatatccaaaacctgagcagaccaataacaagtaatgagatcaaaaccataataggaagtctcttagcaaataaaagcccactacctgatggcttccctgctgaattttaccaaacctttaaagaacacccaatcctactcaaatactctgaaaaacagaggaggaggaaatacattctaactcattctatatttgacagtattaccctaatgttcaaatcagaaaaaggcacaacaaagacacatttcggatcaaatggctttgatccaaaagacagtaacaaatgctggcaaggacatggagaaaagggaacccttgtacactattggtggaaatgtatattagtacaaccactatggagaacagtttggaagttcctcaaaaaactaaaaacatctaccataagatccagcaatccctatatgtgtgtgtgtgtgtgtgtgtgtgtacactaaaaagaaaggaaatgagtatattgaagatatatctgcactcctatgtttattgcagtgatatttataatagcaacctaagtatccatcaacagatggataaagaaaatgcagtatttaaacagaatgcagtactattcagccataaacagaatgagatcctgtcatttaaaacaacattgataaactggaaattattaggttaagtgaaataagctaggcacagaaagacaaacttgatatgtttgaacttatttgtggaagctaaaattaaaataattgaaccatagagataaagagaaggatggctatcagaggttgggaaagatagttgtttggggtagggggagaagtggggatggttaatgggttaaaaatagttagaaagattaaataatacctagtatttgctagcacaatggaatggctatagtcaaaaataatttaattgtacattttaaaaaaactaaaagtgtacaattggattgtttgtactacaaaggataaatgcttgaagtggtggatactcgatactccatttactcttatgtgattattactcattgcatgcctctatcaaaatacctcatgtaccccataaatatatatacctactaagtatccacaaaaattaaaaataaaaataataaataaatatttttattgagtttttttctgtgaattatacaatctcctaggctcttagtctgctaggagatgtagcgatgaaccaaaaagtgctcttatggatcttagggtatactagttaacgtagaagggttgctctaaatttcaaagtgtctgtttatcaaagcatctatgattatcggtgtcttttttgttttttgtttccttattgtttgtttttcatttgagtacttttctcattaaaacactagcttaagcaacatgtcaaggagaaagacaagacaatacaaaagacaacaaaacaagctcttcactgcattgcctcacccataaacttataaagtggctgtcactttataaaaggctaagaaaagctatttcgctgaaaaccttattgactgttttaatgacatcacatttgtagttctgttatgaggaaataaatcatggaaggagtgaggagaagtttagcaatagttgtggtcttacttgctgtgtggtgggtctcagatgccctatatgctatgcaagtagaaatcattgcttatcattttaatgtaagtttgattggaatgtgactaattacataatagttatacaaaaaaacatattctagatcagctaattaagcaatataaaatatgttttgtgcacaaataaagaaacatattgtttcattcctataagatacataaataaagttattttggactgataaatatttttttcaactttcaaaagttccagggtacatgtgcaggatgtgcaagtttgttacgtgggtaaatgtgtgccatggtggtttgctgcacagatcaacccatcacctaggtattaaacccagcatccattaactattcttcctgatgctctcacttcccccaacccaaacccctgagaggccccagtatgtgttgtccccctccccatgtgtccatgtgttctcattgttcagctcccacttataagtgagaatatgtgttgtttggttctctgttcctctatcagtttgctgaggataatggcttccagctccatccatgtccctgaaaaggacatgatctcatttctttttatggctgcatagtattccatgatatatatttactacattttctttatccagtttatcactgatgggcttttgggttgattccatgtctctgttattgtgaatactgctgcaattggcataaacgtgcatgtatctttataataaaatgatttatattcctttgggtatatacccagtaatgggattgctgggtcaaatggtatttctgcctctagatctctgaagaatctccacactgtcttccacaatggttgaactaatttacactccccccaacagtgcaaaagcattcctttttctccgcaacctcaccagcatctgttgtttctggactgtttaataattgccattctgactggcatgagatggtatctcactgtggttctgatttgcatttctctaatgatcattgatgttgagcttttttcacgtttgttggctgcataaatgtcttccttgagaagtgtctgttcatgtgctctgcccactttttaatgggattgtttgttttttcttgtaaatttgtttaagttccttgtagactctggatattagacctttgtcagatgggtagaatgcaaaaattttctctcattctgtaggttgtctgttcactctgatgatagtttcttttgctgagcagaagctctttagtttaattagatcccatttgtcattttgcttttgttgcaattgcttttagcgtttttgtcatgaaatccttccccatggctacatcctgactggtattgtcagattttcttctagggtttttatagtttggggttttacatttaagtccttaatccatcttgggttaatttttgtataaggtgtaaagaaggggttcagtttcaattttctgcatatggctagccagttctcccagtaccatttattagagggaatcctttccccattgcttgtttttgtcaggtttgtcgaagatcagatggttgtaggcatgtggtctcatttctgagttctctattctgttccatgggtctatgtgtctgtttttgtaccagtgccatgctgttttggttactgtagccttgtagtgtagtttgaagtccagtagtatgatgcctgcagctttgttatttttgcttaggattgtctttgctttttgggtgctttttgggttccatatgaattttaaaattcaacatcccttcacgttaaaaactctcaataaactaggtattgaaagaacatacctcaaaatagtaagagccatatatgacaaacccacagccaatatcatacagaatggacaaaagctgggagcattcccctttaaaaccagcacaagacaaggatgccctctctcaccactcctactcaacatagtattggaagttctggccagggcaatcaagcaagagaaagaaataaacatattcaaatagggagagaggaagttaaattatctttgtttgcagataacaggatcctatgtctagaaaagcacatcatctcagcccaaaaccttcttaagctgataagcaacttcagcagtctcaggatacataatcaatgtgcaaaagtcgctagcgttcctatacaccaacaacaggcaagcagaaagccaaatcatgaatgaactcccattcacaactgctacaaaaacaatgagatacctaggaatacagctgacaagggaagtgaaggacctcttcaaggacagctacaaaccactcctcatggaaaactagaaaggacacaaacaaaaggaaaaacattccatgttcatggatagaaagaattcatatcacaaaaatgaccatagtgcccaaagtaatttatagattcaatgctatttccattaaactatcattggtaaatctttttaagaaaaatttatagtataaattaatagtttaaagatggcaatttttatttagatagatcaaaaaaaatgctgtcacagagagatgtgaattgaactacctattgaggaagtatgttatcattaatgctttctcacaatttctttcatattaaggattttaaaaagttaaattatatacaatttcatttgtatcatcactatagtttctttatcaaatatgtgttgagtaaatgctgtgtttcagacattgtgctggaattggagatataatggtaatgaaatgaaggatgcctcatggatcttacagtctaattgaggtagaaatacaaatacacatacatatatacaacacatatgcacatactaaataatcacacaaatatatgaatatttactttcagataatgttactaaattgtggttatttctgtgctggcaagaaacacccagtttcttgaaatttacttttcaatgacttcttccaaatttaatcctgtttatgcctaaggatttttgttgttgtttttttaatctcttaaagttgcacattgaatcactgctgatttgtatgcatgaagttaccaggacttctaattttgtaccaagtttatatgtgctaatattttccattagtaaagaagactgaaagatgcctcagttgcctggaatttatgccaccaaggaaaaacagtgattagtgtgtttaaagagttagatcattgggttaatcatgctttgccatagtatcattgctatcctttaaataaaaaaaaaaggtttagttagaaaattttttaacaagataaaattaaccacagactataacgaaaagtaatttcagcaggattatttattctcccaaagttgaaaaaacaacaaaccaaaaaaggtgtatatgtgacatctacttaattttttaaatatgattatttccatcttttgttctttgatctccacatgagcagagacacataaagtggcaatggggccaagggtgctagatggcttggcattcattaactatggcaattagcaccatttagattgatatgttcccaagatgaaagtaagaattggactagacaaaaaaaatgatgatcgcatttgtgaaagtggaacaacactgaccaacaagaaacaaagaaacagagctcaccttaaaagacttggaatatttgaaaaattgattatgagataagataatttcaacataactacaattccttgaagagttattaatgcttcggtagcattaaagtaaaatgaaaagacaccagggcagtctgctttaatagcttgctggcttgaaccctaatacataatgttcttgtaatagtttatgggtgactgcagtaaattggtagtgaatgtttttcatttttttggctcttcatatcagatctgctcttggagaacattttgttctgagaatattatgaaggcagttcatctactttagaagttgcttgacaattttaatacagtgttaacttttctcccctccagattgtgtgatttttttgtcctttgtacccgacatcaatttatggtttgaaattcagcaatttgctcagttatactttacctaccctgactaaatattttaagtgctgccacaagaaaagaaaaaatctaatttttcccaatgttgttgttacccctctctgtttatatagcagtttaaatctgcccttcatcttgacagagaaaaaattttagatggattaattttgaacctaaataatttgttgacaaataatttatgatcatattcaggggttgttttgaggtaaaaagaaaactgcattgaatgaattataccaagtgaaatcatggtattttaaacaaaatgaggtttataattacctgggatttagtgaacaaaagtatgtgatgcagggctccctgaagaatttagtgcatgtcctatgttttagtgcttcaagcagcaaatattatgtatatacaataaaaaaggaagttgcagacttaatacatactgaaatggtctcaatgttaacattagactcatgaaaaattagcggacatctaagtactttattcgttcttttagtctttgctgtacctaggaacatttgtttcatataaaagttatattacaaaattaatggactgagggtggaaagagaatttgaaagaatgtgaaataaagtctggatatatactgaatgcaggtggaagatgtctgaggaacattaatgacaataaagagaagtctcttcctaagttacagacatccaaaaccaaaataagagccaatgtggttacataaaactgcaaagaaaatcttggttggacagagaactccgaagaggtagtaaaaggaaaaactgagcaaactagggaagacaaatgcagagaaaagttagaaataattagagaagaaataaaatgcttccacaaaaataagaacaacaaaaattcaggagataaatgcagaacagtccagctaacagaaaaggatttttgaactgtgtatgcaagaagcagacagcatgattggaaatgaagtatttgctctttcctctaagagtggaagaacaagacattcctgggcagcacaactctgcgtaggattagttgcacttcctcaaatgtattttcaagcaaaaagctgaaacccaaatgtcttgagccaccagaagtacccaggctcttatgtaatacaggctttagtgttttattgcttattcaaaaagacaaattatattttaaaattgatatatgtgtgagcatggttatgctacacctataaattaccaaacgtaataccaatagcagccaaccaacagtttagcctcagtattttcacaacagttcaaaatgttttgttaaatcccatgaaagtagcttcagtgacaaaggtttcagatctttgcaaatgataattaattcagaggcatataatgggaaacactacagtcaggtctagacaggtttagataaactaatggcccaactagttatggcagctacagtttttaacttcaagtaaaggaatcttaaagcagttcaaggaagaaacattttctttcttttcctttttaaaacatttaattgtcttttttgaggatgataaaagataaaatctagagactttattgtactgtactcattatagtctctcccctgcctcatatgtaaatctagtttgcttcttcatgtttattcatctctactttaaataaacatattgtacatatactctatacacacacacatataatacctattctcttccatttatgcttacattgtaagtcttttaaacatttattgaaacatttttgttggattgactctacattgaatagctttattataaatgaaagacttcccttctattaaacagaaatttcttttaataccactatgaggcagaacattattgctatggtataactttgtacgatcgaatgtcctactggttagatctgtgagttaatttaaatttttacaggctgttagatggagtaaaaggcaggatacagccatggactgtaggttttttatcctttagttacttctttaacttttaatttacattaatggacaagtttcatctagtctaattttatgtattacttgagtctttcctcatatttttggaatgccatttttaatttagagtgttttctaagttaaagtcttaattgttcttttcctgaataatagcttgcatgaatacaaagaactttatgtttgaattttggatttagtcagcttgatttttcactgaaatcaggcctaaacatatgaagttcagcagcaaaaacaaaagcaagcttacttactgaaaacgcattgtctttctataacaagcttactgtaaagactggggtagtatgtatatttccatagatacatatatatagtatctgtgtgtacacatatacacgtaaagttaagaaagtttgtaaaaaaactacacatacgcaacattagaaatactgttaaatatttatgtgtaatgaagctgttcttttcaatgatgtcctacattgtaaaggttttatttaaaaatttttatataatgaatgcaaacttgagtcactgttcaaacatgaatattttctcaaatgaacatatttgcatgtgttatgctatataaactgagttctgtaaaaaggatcctttttcttctgctaccaagaaattctacttttataattcaaacaatctactctctcccacactcaaaataagtcatcattacttaaaatatgtgtagtgtaacaatggaaatgtttgtatatttgtcaaactaaatattatgttaaaatattttatacatttccactgagaatgctcttcttagttaaaaataaataaaatttaaaaaaatttgaatggagacattttgaaagtggctattccaggtaggataaatatttaatttactccatagcataataattttaggaatcacttcattttgaaaaattattctgaatactagcaacattttggcctttaagacactttattaacagttttgaagaaaaagttgagacatttgttcaaaagatttgaatctattcacataatagttcagacaatctccatttttaaattcctaaattttgaaaatttaggatacgtaaaaaagataaattaaggaatgatggtttaccacatggaaaaagtattatttataaaaattttaaaagtataatttatttacaaaatttagttatttaataacatatataaaaagactcaagttgatattctaaaacatacttttaaacaaaaggaactgtctattacataatgaaaatttatgcaaccaaaatgagtattattctttgcaaagtagttgccttgggagacagttctttaaacagtatagctattgctctaaatattgcacaatgtgcgaacaatgttgaccttcagtgccaacaacatatcattttgaatattttcactgacaactgctctttaattttcgttgctttttagaaatagtcaagagtaacttagagccatgtttacctgacagagccaagtttattgccatagcaaaacctggcctgtatagttatagaaatcccttatcttcatttcttcacctccaactctacaatctactccaatttgttgtcctttgcctcctctactcccttcaaactaatctttctaaggctgtaactatctgttttcagtcaccaaatgggcaatcatttaaaaaatattatggaaatgataaaagccatttatcttgggtggttttgtgcagtttctaaaggcagtttcaaaagaggtaagtaactttgatagtgatagaatcattggaataaatatattaccttcactatgacaaggatatttggatgtttaacttttggatatctgatatgtattttccattcagtgcagtatttattgagcacctatattatgcaaaacactgtgcgagatgctgagacaaaatatgaagatgaagaaacaatgagaccagccctgactcatgaacaaatagtgaggtaaggagataaccttcaatgactctactgtgagacagatttaagtgttctcttggagttagaatgcactatataaatagagagggaagaattcattttaactgaagcatgacagttaaattgtgcctagaaggacagagattgaaaccttaacaggtagaaatggaagaaagaactaggaagaggaagtaagttgttcaatgtagaatagggtttctatctttttttaaaaaatggacagtttactttctattcatagcttacacagtaaaactgtgcttgtttcaactttgctggcactacacaatatgcctagattcaattctgttgaatcccataaactctctttttttgttttgtttttcattccatctttctatgcctgtgccccatgtgttctttctcagctctcatgtctgtgtctttttcagttctgcatcaccttcttttcttctacatctgtttctcacctttccctgtctctgctatcccctctcgtagtcatctttccgtcttgattgccataaggaattgaaatatgctatacttctctttgacaaatccaaacttgaataaactcttacactatggagttttcaacaaatccttactctttgtacttttttccttttttaaattgttccttcccttcacttaattccttgtaatctgtccaaattttatattctcctcccccacttttctcccttttctttctctcctttttgattcttacactacactactggtgtactcagaggaaaaaatgatgctaaaataaagaaaatgttctttacaatcagaatattattaaccagtacttccaagcataactagttcaatcataaaagttcatttaagatttcaatgattccaacttatatctctttatctctttttgagtcaagtattaaatgactagtacttcaaagttaaatgtattttactgtataatttttgagactgatcatttatatttgatatctatatctcatttcataactatactacatggtctaatgtatagcatatggaaagtttttgtagcttacctcttcttgcaagactaaatgagaggactactgttggcagaaagcaaagttggtcaaggccaaaaataggactgactgttttctttagaccctccctttttcttccttgtaataatcttgaactcctagattccagtttttcctttatttagccaataaatatttactgaatcctaactattttccaggaactatggtaagtgctattgatagatgtattaggccttctttgacacggaagagcttacaacctaggtggagagggagaaacataactgcaatataaattgataaggcccataatgggacgaagaacaggctactatcctcattatacatctggtactcagagacctctacgttattccttggattttccccatacttgcaacccacctttttatcctcctcattaaaacttacctgttattgaatcccattttcccttaaggcaccccttttggataggtgctttgggaaaacaatcccacaaattaactcacactggatattaaaagagtaaagcatatacctcacatccctcttgcattttaacaagtcagtccatttgaaaagaactggttgctagtgatgggaatttcaagaactgtacagtaggccattagaaaagtaaaactttcctcatacacttcaatcacaacagagaggggttgaccgtacaacataaaacttccttttagatgccctaacactattattatttaaacaacatagcagctacatattcactaagaaaatacaattgaatttaattgttgttagtagtagtagttaccgctagtaactactgttactaaaatagaaattatatatcgatttaaaattataaaatttgccttattctttctttaacttttattttaagttcaggggtacaagtacatgtttgttacataggtaaatttgtgtcatgggggtctgttgtacagattatttcatcaaccaggtattaagccaagtatccattagttatttttcctgatcctttccctcctcccaccttccatcctctgatgggcccagtgtgtgttgttcccctctatgtgttcatgtgttctcatcatttagctcccacttataaatgagaacatatggtatttggttttttgttcctttgttagttcgctaaggctaacggcttacagccctatccatccatgtccctgagaagaacacgatcgcattctttttatggctgcctagtattccatggtgtatatgtactacattttctttaaccagtctatcattgatgggcatttaggttgaatccatgactttgctattgtgaatagtgctgcaatgaacatacacatgcatgtgtctttataatagaatgatttatattcctttaggtatattctttgatattattatgaagattcacatgaaatagcaaggaatggttttctagttggaaaagtatgattcccacaataaaagtaataaaatataataagaaatatttacatatatcaagaaaaaatgattcatgggatcacaaaataaaaattatacaaattgaggaaagccttatttaatataatgtctttaggaaaaaaattagtatctgtggacctgggattcctcccctgtaaaatgaagggtttaaataagaaaaactccactttcttgcttccaggcttaacacatatgtgaatcatttgcataaatatttctcaattttcctactacatgaaattttagttgctacaatatcacaattaggcagtctgcataaataaaggagtttctcttatatttctaaatataagagaaatatataaaatatactaaaatactaaatatataaaatatttaaaaatactaaatatactaaaatacagtactaaaataatgcctaacacaaagtaactgccttagcataatttaggtggctgattggatggattaaagcttggattaatagaaaaacacaatgatgcaaatgtgaagtcaggtatatgtctacacatctaacaacatttaatgagagacactgaagacccagaaatgagtatttttacaggcttacaaataaccgatgttcaatttgggggtcaaaacaagaaatagagaaaactgaagtaagttaggtaaggtccattttgactaggattatttctggcaatttcccctcatctactttctgcaaattcatgcatgttcactgtactgtgcttactgacaatctgtaccaaataactcctggcagtttgaaatcatttcatctataacatataaataccttatttgcttcaactgtacaaatgctggaccccatctcaccaaagttttctagaatttaattgttcttcacctaacatctttaaaactcaatttattggtctgtaaaacagtaagacctacattatagagttattgtgacaatcagacggactcaaagcatgtcatagtttcacttacgtatctaccaacccactatcattagccttctacttgagaccaacccctttacctaagtactaaatgtggtaatccttgaagtctctgggacttttctatacaattatcatttttctctgcttgacttcaatgtcttctctgctggctctttatttttcaaaacatgtaaatcatttgtattctaacattaccttgactctgtgcctctttttaccaacaattctccctcctttcatcacctgtgtatattgattaaataaacaaaaaacaattcaaagtaattttatatgaaaaacattgcgggaggaaaatagaataaaaagcaacagtaacaatataaaaaaaaaatcacctgttgtcaaccacaggcatttcttcccaggtgtaatatagttatataaaataaacttgtcatcagaagttttgaatctcagtatttttgcttaatattaaattttatatagcattaccttttctaaaaaaagtgttaaaatagtattttaatgactgcataatatcctatagtaagaatgaaatataattcatttattcattcctacatttagacatttaggtactgtcaaaaatttttgctactataaatggttctgataaacatgcttgcagataaatctttgcatacgtctctgaatatttctacaaaataatcttcaagattggaaattattgactaaagtaaaataaacaatgtgaatagcttttacctttctgacacaagcttaaagtctttgttctttcattaagggaaatttttccatttaaatttatactaaaaatattgtgttattgacaaggcaagtaaagaaaagaaatcaatgctactgaatcaggcactctgatggatattctgtctcttcctattcaacacattttcctttggcaatctcttttcatgagcttatcaactaccaatgtattgatggcttccaaatttctcttcaggtatgaattctcctttgagcttgaaactcccatgtccaaaggcttcttgactatatcctatggtgtgtcatgcagtcctttggattctgcattaataaaagtaaagtattcttacttcacaaaatattctgtaaataattacccaattttgttaatcaagtcatatggaagacaatgcataaatatacaaaataaagaataagaaatgtactacaaatattcagaaagcattaaaatatgtcaaaatactgttacagatatatactaataaaattgaaaatctcaggacataatcttctaagaaaatatacattttcaaaattgactctataaatggaaaattttaacaggccaataaatttaaaaattaattaagaaaggttccagaaacaggtggttcaagagcaaattctatttaatttcctttttcaaaaattgatagataaaattctatgtattttccatgtataacatgtttttaagtatacataccttgtagaacaactaaatttagctaattaacacatgtattacctcacagttatttctgagtaaacatccattcattatttttcaagaatacatgtattattaactatagtcatcatgttgtacaacagatctcttaaacttattccacctaattgaaatgtcatatcatttgaccaatatctccttaaaccccagttttaatagaaaattgaatttcattaagttttcaaggatcaaaataaacccataacatagtaacaaaaacaaaatatttccaaattcattttctgaagctagcaaaagcctaaaacagtacagcaaaggaggctactgagcactgttacttcactccattgaattaggactggatgcaagtgtaaagcatcagatttatagaacttactataaaaaactctaaaatatctcattaacattttcatattacatattaaaatggtaatatcttggctatattgttttaaataaaatacattattaaaattaacttcatctgtttctttttactttttaaaaatgtagtcacaagaaaattttaaattgcatatatggctcacattgtattcctattagtattaatatagataattttgcttataaggatacaaaacttctcagcgagttaaatataacaatatattaaaaataatttgtgatgaccaagaaagttgaaagttttccattagaatatctactaatatatatgataaatttatataagtatgattttaaaaacaataattttgatagtgctgaaaatgcatgcaataaaaatcaaccacaattcttaattttaaaactcttaataaactatgatgaaactctttaatgtaatgaagaatatctacctataaaatggttgacactacacctaatggtgaaaacattagtggtattcccagtgaagccaagagaaaaacaaactcttgctagcacttattattataatttggaagctccagcaataccacctaacatgaactataaacatgagaaaggagtagaataaaaaaattaagaaataattagaacttataaatcagtaacctgcttgtttactatacacacacacatacacacacacacacaccaaaaacagccatttaaaaatgcaaaggaaagaacaatctcttattaccaatgataaaaaataaaaactacatagaaactaacactacaagaaaaatgtcagacttatatggaaaaaatgtttttctaagtaatgttaaaaaattttgaataaattaagacatcttccagatgagaaacctctatgtcaattctccctaaaacagttcataaatttaatgcaaccactctcagaagtccaataaaattgaagggggggggcagtggtagagagaccttgattaaataattctaaatctcttataaaaaattggttaagaatagccagtaaccttttaaaatgaaaaatactaaaaagaaacttttattagcaggtttaaactgtattgtaaaagccacaataaatagtgtagtcctagtaaaccatatagaaactgatagaactgaagagaaaaaataggctggaaatcaaatagaaagacaagaaacaagcctatttgtaaattaagtatttagcatatgataaataatgcattttaaatcagtgggaaaaacatagattttttttcaattgatggtgctgagacaactggttaaatatttagaacagagtaaatttagagcctatctcacactgtatatcaaaataaaattccagatggtttgaagagttatatgtaaacaataaaaccataaaagaaatagaagcaaatacagaagaatttttaatcttatcttgggttggagaaggtcttcctaagcataaaagcaaaggcagaagccataaaaaatgtaatatggtttttaaaaatagaatatttgaacacataaaaatgaaaggtcagtatagcaaaaacaaatgaaactaaaaggcaaacaataaatttagaaaaaactatttgcaacatatgacagagtatcatatagcagctgaaaacaatgtcctatgaaaaataattaaggacctgggaaaaacaactagcacatagtgttaaacggagaaattgttataaaacagtacatacattattataggaactttgtaaaatacacttacatttgggtataatggtttcccacatataccatgtttataatttccatgcttttatacatatagtcccctttgactgaagagatcctccttccttccctgtctatacatctcctattcatctttcaagcatcatttctgacatccctttagacaacaagaagtcttctttgaattatcaggctggaatatgtgcccttcctttgtttgcccatagtacattgttgtacaccatcaaattaatgctatttaatattatctgtttacatgtattactccacccctatgattaaagttccttaagagaaagggtaatattttacctctttctgcatgctcatttcctagtattatatctgtcaattagtacacattcgaaaatattggtttgaattattgctaaaatgtcttctaattaagattattccaaaatgaagctaacatcaatagggagacaaacaacacaagaggcatcaaactgtataagaagtctgaaagaaaaaaaagacttaacgtcatgagagatgattctgtcctcattttcacgttaaaccagaagcttccttcagggtacagctcaatgagtcaccctagagtattctaggtatatattgatattcctaaaaatctaaacatatgtaccatatacaaaccgtgtcccacaatttatcacttaaagtttattgtttttaaatgatttctcatttatgagtcttttctctcattagacgttaatctctgttatgtgaagaggtcatgccttatctaggcagatatcctacaaagtgtttggctaagtaccctagtactttaataaaaattcaatatgcacaaattttctatacagctttaagtaattttctgtttttatttacatacatcccttcataattttctaagaaaatcaggatctactccaatttcctcattacccatcatcatccagaatgatgaagagatgtatagattattaagaaaatatttgcgtttgctgagtaaacccgatattatctaatcaaaagaacagcttcggctgtgctgctcctagctgtgctagtccacacagctttcccagttttcatgaattagtggaggtaatgttaaaccacttttctagtaagagtgcataaggatatttaagtgagctcatccctctaacaaaggaaagaataattttcattaatcattattcaacagtacatcttcttgaactaaatcatgagaggaggaacttatgatgttttttattagtcaaaacattttctatatatagcttagtatatgcaacgtgccaaattacagaattctatttactgctaatgtcaatttaccaccacattgcttgatataattcaaagttttccaaggagctatttgacctcctatagactgaaaataaaatcatgagatttaaattacttaatgccaaaaaggaaagtcatctttttctccttcttatgtctttgtttcataaaactattatcagacagtccatgcaaacaactaaaaacaaaaaattatatggtgtagttaattgaaaaaatgcttttgctacacacagaaattgacactaagtgctgtattagaaggaaatcagtgattttcaattgacattgcacaggaaatcatttagtgtcaattgatattaaatgggtaaaattgtactgaattagtacaaaatgatttggtggaaaaaaatgtgcttccattaggtgacttgatattaagtgggcttaaatgtaataagttttagaggtcactagtcaacaaaaattggggcatgctattcaaccctgagtacatcagactgcttgctcttaataccctcatcaaaagataagttagtgtcatactatcatgacaaaattgtcttcctttgggctttcaagggaagtgggaaaattcaaattgtttaaatgagctaaattagccagtggtaaggaccatgacttcttagatttatctggtggtcctaatcctttaaaaatatttttttttctagaatttttggcatgaaatgaaaggcaacataacagcacgtattttatgtaatatggtccagattgcgctttctttataaaatggctttgacagtaagcacacaataaattatattgtgttagggagtgatatgattatatataatgaagtaaccactttattgatcttttaagaaacctatgtttttaaacctgagtaatgaggaaagagaagtgtgtggctgcaggagacacaaggaaggagaagaaacaggaaaagttacattacacagtcactacaagaacaaattgaataaaatattatagatattttctgggaagagaaatgggggtttgtgaggtacagaaaattgtaaaactcatttgttacttagtaatacaagaaacaataacaataaaacagacatactgggaacactccacccaacaaaaacagaatacgcaatcttctcaagtgtatgtaaggcaattaccagtgtccaggatagaccacatattaggccacaaattaagtctccatagatttaaatagacaaatatcatacaaagtatcctttctgaccacaaagggataaagttagaaatcagtaacaaaatgaaaacagttaggcaacatactcttaaacaaaggatcaaaaaagaaatcacaagagaaattagaaaacacccagagatgaatgaaaaagtattatcccaaatcaaaacttaagaaacacagcaaaaggagtgctaaggggaaagtttataattataaatgcttacattaaacaacaaaaaagacctcaaatcagaacctaactttacaacctaaggaactaaaaaaaaaaaaaaaaaaacaaactaaacccacagctagcagaaggaaagaaatacgtattagagcagatgtaaaatacagaatagaaaaataagataaaaccaataaaaccaaaagttggttcttcaaaaatattaataagattgacaaacctttggatatatatactaagaaaaaaagagaagactcaaattacaaaaatcagaagtgagagaggaaacactactactattctacagaaataaaaatgattataaaagagtacgatgagcaattgctaggccaacgaattggataacctagttgaaatgtagaaattcctagaaaaacaaaacctaccataactaaaccacaaaggaatagaaaatctgaatagacctatataacttgtaaggagattgaatcaatattcaaaaatctcccaataaagaaaagtcctggacctgatgacttcactggtgagttctaccaattatttttaaaaagaataatatcaactaaagtttcctcaaaaaacaaaaaattgagctaccacatgatccagcaatcccactgctgggtatgtatatacccaaaagaaaggaaatcagtatatcaaagaggtatctgcactcttatatttgttgcagcactgtttacaatagctaagatttggaagtgtccatcaacagatgaatagataaagaagatgtggcatatatacataatgaagtactattcagcaataaaaaagaatccctctcaaacttttccaaaaaaatcagagaaggaaacactccctgattgattacatgaggcctgtattaccctgatgccaaaaccagacaaaaacacaataaataaaaacaacagaccaatatctcttatgagcattgacaaggattgaaaatccttaacaaattatagcaaaccaaattcagtagcatattaaaaggattttaccctatgaccaagtaggatttgtcgttgaaatgcaaggatttttaacagatgtaaacccatcaacataatacaccacattaacaaaataaagggaaaaaacaataatcttgattaatgcagaaaaactacttgacaaaatctgacatccttttataataaaaatcctcaaaaactaagaataaaagtaaaaaaccctaacataataaaatccatgtattaaaaactcacagctaaaataatactcaagggtaaaatactgaaagctcttcctctgagatcagcaacaaggcaagtactattccacataatactgaaagtcctagtcagagcagttaattaggaaaaaaagaaatgaaaggcacccaaatcagaaagaaataagtaaaattatctctgttcacatatcatatgatctcatatgtaaaaaacatattccacaatttccaccaaaaaaaaaccctgttagaactaataaataaatacaacaaagcagcaggataaaaaaaatcatcacgcaaaaatcagtcacattgctacacactaacactgaacaatctaaaaagaaaactaagaaaacaattccatatacagtagtatcacaaagaataatactatttagaaattaaccaaagaaataaaatttttaccaataaaatctataaaacttttctgaaagaaattaaagaagacataaatgaaaagaattgtgttcacgaattggaaggcttaacattgtcaagatatcagttctgcccaaagtaagatataatgtattccctataaaaatccaaattatgttttcacagaaatagaaaaactcatcccaaaattcacacgaagtatcagagaacccccaaacagccaaaacaaaactaaaaatgaagaataaaaccaaagcactcaaacttcctggtttcaaaacgtactacaaagctacagtaatcaaaacagcacggtactggcgtaaagacaaactaagaaataaaatagagtccagaaataaaccctcaccagtgtggttaaatgatccttgaaaagggtgctaaaattattcaatggggaacagacagtcttttcaataaatagtgattgggaaaagtgggtatccacatgcaaaagaataaacttcaatccttacctaacaccatatataaaattaattcaaaatagattctaaatataagctttaaatataagatctaaaactataaaactcttggaagaaagcatgaggcaaaagcttcatcatactggatttggcaattatttgagtatgacaacaggccataggcaatgacaacaaaaaagacaaattgagcttcataaaaattaaaaattaaatgcacctcaaaagtcaccatcaacagagtaaaaagccaaaccactgaataagggaacatgtttgcaagtctcatattggataaggggttaacatccaaaatatacagagaactcctaaaaacacaacaacaaaaatctgaatcaaaactgtgcaaagaacttgaatagacatatttccaagaaagatatacagatggcaaacaagcacatgaaaagatgttcaacatgactaatcatttgggaaatgtaaatcaaagctacaatgaaatggaatctcacaccaattagaattgctactatcaaacacacacacacacacacacacacacaaaacaagttttagtgaggatatggagaagttggaaccattttacacctttgatagaaatgtgaaaaacagcatggcagtttctcaaaaagttaaaaaatagaactaccatatgacagagcaattccacctctgggtatatattcaaaagaactgacagcagggtcttgaagagatatttgttaatatgttcatagcagccatattcacaacacccatattcacaattactaaaatatggaagcaattcaagtgtctattggatggataaatggatacacaaattgtgatatatatacacaatggaatattattcagtcttaaaaagtaaggaaattgtgacatatgctacaacatcagtgaactttgaggacactatgctaaatgaaataaagccaaacacaaaaagacaaatattgtatgatccaatttatatgaagtacttagggaaattaaatcataaagacagaaagtacaacggtggttgccaggttgctggtgggaaggaaaaatgaggagttgttcttttatgtgtataggctttaagtttgcaagatgaaaataattctggagatacttggtggtaatgggttcacaataatatgaatgtacttaatgccaccaaactgtacagttaaaattgaataaggtggtgtattttatgttatgtgtattttactacaataaaaaagttgaaaaaaaaatgaaagaaaagctttgtgatttttttttctttcttttttttttccgagacggagtctcgctctgtcgccaggctgaagtgtagtgtcgcgatctcggctcactgtaacctccgcttcccgggttcaagtgattctcctgcatcagcctcccgactagctgggactacagtcttgctctgtcaccaggctggagtgcagtggtgcgatctcggctcactgcaacctccgcctcccaggttcgagcgattctcctgcctcagcctcccgagtagctgggactacaggtgcgtgccatcacgcccagctaacttttgtatttttagtagagacggcgtttcaccatgttggccaggatggtctcgatctcttgacctcatgatctgcctgcctcggcctcccaaagtgctgggattacaggtgtgcaccgcagcgcccggccactttgtgattttttaaatgtgacctgccccaccccaaaaatacatagatagggaactcttcatggtaatcactgggcttgaagagatagcattaaccttttttctaatttggccctgagactgaaaaatatatatatccataggaacccatacagaacttacgatgaatgtccacgaagtaaaccaagaacattccccctagcattagcagagagcattctaaaatataatttagtttcatcacagaggaagcttacaatgaaactggagctacattcaggacagtctttaaggttcaggagaatgatttgctgattcaaatggacaacagagaaatctgattaaataataatatatttatgatcattactgtttattaagcttttactaatagtgaggataatcttcagcattcttcattaactatcaatcgttttgcttaacaatctgataaggtccacctatttcagaaacaaagatcatgagattaagaaaactgaccaaagtaacaagcacagtaaggtgttaaacccacatctatctgaatccaaagtaaagaaatttttggggggggcggagtgaggaggtggaaacagagtctcactccgtcacccaagctagagtgcagtggtgcaatctcagctcactgcaacctccgtctcccaggttcaagcaattctcctgcctcagcctcctgagcagctgggattacaggcttgcacaccatgcccagctcaatttttggatttttagtagaggcagggtttcaaaacgttggccaggctggtctcaaactcctgacctcaaatgatccgccagcctcgacctcccaaagtgctgggattacaggcgtggccaccatggtgggccccaagtaaagaatttttaactaggtaatttggactttcaaaactgggacatagttggtgatttaaaataaaaatcctcttgcaagaatctgaagctaaaatgttccaaagcacaacaggagctgtgaacaagttagtagtctataaggagaagtataaatacattggaagaattaatctagggggaggaatgtggtttaagcagtaattgataggtgaagatgagcacaaaaatcagaaaacacataactgtacctgtaagttgctattcctttaaatcttgccttatttttaaataaataaatatgctagaaaacatttattctttgtggttttagtacatagaataatattttaatttccaaataccacaaatgaggtctaaaacatgattaaataattaactccattatccttacaatagaaaacttagctattcaaacaatgaagtttcacatgggtgatgccacctcctacattgtcacacattaaaaagttatagtcacaggtttttaaagaaataacagcttttccgggttaaacttccaatctcaagcctattcatgatgataaatgtcacagggtcaaagacctacagggaaaatctacgttagctctaaggtgggttaaccagtacacactgattaatccaaaatccatttgttaggaacaaggcaagtactacacacccttcattttgaagatactcataaacccaattaacaattttcaatgacaaagcttgtccctttgtatgtatgtataataacatcatagaactctatacaagcacatacaaaacaaggtgaaaactgacttggccatacaggtttgcaatctaactagaaagcataaatatcacaaataaatagatgtaaatacaattagtacattgataaacatacttcatactcttatgcagtaaatactcaaaaaaataagcaatgaaaataacatagaatacttgttgaactgactaaactcatcccagtgaagtttcctgaatacattttccttgaatttttattataaaactgcagctaaattttgcctaaacaagtttatccctaaatgtaaacaatgcatccaacattatagaaatcatcaatttttaaaaatctgttgttggtaaactattaacgtcattatattcaaaggaaatgttaaaattattaaaattttaatattttaattctaaaaactatatactactatcaacatttgcttcacacatctgcaatatgaaagtggtaacgtctaaaggtttaacattttaaaataatattttcaccttttagccattgcattatatcaaagttatgcaattttttacctttttattattattttttgcattctctccctttactggagattattgccttcttctctgacatcataactagataatatctcaatgacctgttactgtatccttggataagaggagatagcatctccagtaaggtcaaatatgagtcaaccatgtgatatgggtactgaaaaattccaattaaatcttaaactgacctgacagaataacagtatctagaatgagggagatgacattcccactctcatcagcaatggtcagatggcatgatcaatactgtgatacatgacccagaagcacaataatatcctaagaagggggaagaggaagggtgaaagactagaatcataacatatttggaatggtagaaagaatcaagggtattacatgttgactatgcgattaggaaaacaatcgggatagaaaacgtttcaaatgtttgaaaacttcaaatgagattactctgtatgttcccaaggcatatactattaataaaatgatgggttgagaatactagatacaggtttcaactcaaagtaaataagaacctcttaacatcagaattgctcacagatgacgtgttgcttgaaatattagtgaacatatttcaagcagagactggaggtgtttaaagcagttttacaatatgattctattagtcttctcaaagctcagaattaaaatatttaataatgctgagtggtggatgtttttacagtgtggcctggaatctgcagttatcaacctacaagtgtctgatttttattagcaaagtattaaaaagttgttcattttcccaatttaagaagaagtttatgcactggacattgcttttcaaaagttattttttgaatagtggtaaccaaaggttggggcttgcgtagtggggagaatggggacatgttggtcaaagggtacaaaatttcagttaggagatataaattatggccatctattttacagcatgaaaacacatagttggtaacaaataatgcactacacacctgaaaattgctgaggatagattttaaatgttatcaccatacacacacatatacatacacacaaatgataagtatgtgagatgatagatatgttaagtagcttgatttattatttcacactgagtatatatatgttaaaacatcctttgctcaccataaatatatacaatttcatttgtcaattaaaaataataacaaagttacatatataattttttttatttcaagtggtatggctttatataatgctgaatgactcactgactgattgaatcactgtcattcattcaacagacatttattcagagcctggtatgtgccaaagactgcaaagtggcatacaaaaagaaagaataagacaaagcctatgcttataatatgtcagggtaagtagacacccaaaaataatcattttcaaagtttaagatcttattctagaagcctgtgctctgggagcacactggaatggcatttaactttccagaagaatcaaggaagacttcactgaggaggtgatatttgagctgggctttaaaagattaataggatttaactagatagcaagggaatggaatgatatttcaggcagaagaagcattatgtactcagaggcatgaaagtacatggtgtggttagtgaaaaaggcaagaaatttggtaaagctgaaatgtgaggtataaagtatggaaagagtgaaaataagactgacaaagtagatcatgactaaatatttggggtcaatataagccatgctaaggtgtttgggtttaatcttgggcacaaagaaatgttttcaagtagaaaggtaacatggttacatttgcattttagacaatatatgtgcatcatgtgtgagaaactcatttctataaatactagtttttgccttgaaacatttcagggggagtggaatcctcgagttactggcaccagcaagggtaaattaatgggcactagatggcggcatagagtgcccaattcttcataatatcagttactatttctgagcctgtatttttgacttaaataattcctttattcaaaaatcccattaaatgaatatgcactatttagactgattggcatgaagtaatagactactgtaaggggaacacgcattttttaaaagaggtaaagcccatgttggtgcatgatggaaaaggcagttgaggattataaaaatatttggataaaattaaaaatacaactttgagttcaatggaatcttaaatttctcttgcagaagttgccattcgtctttaaataataatacatatatgtgtaaaacacctaaacttcataaagtcatgttatattcaccatctgtcctcttcttcaattaccaccattaccacatggacaaacattacaattcacattttacaaggaacgaaactgaggctcatgtaaatgtttttcccagtttatatggtacagttaataaataatagtaccaaaaccaaaactctagtttttttattacaaatccagtctttggttcactttgtcatgtttcacaactgaaaaacaattgggaactaggacaagattaagacaaggaaatgatagaaccaaatgattctaatgccattctgtgataaacagagagcaaatactgtaaattggattgtatattcattaagcccatggtttctgacaattattttggaagaatttacatgtcaaagaaaattatgaccaatatttagttataccaaggaatttacattggagaagctctatatatttttaatgtttggttgataatatgttaacaagatgattagtaagaaacacaaaaatagtttgtaacttaagatgtaaaagattccaaataactataaattccctatggagaagccatctctgccccatgtcatcatgcctttaaaattagacgcaaaagtttgaatactcaacagtagaattgtttatttagtagtgtggaaggtctacctctgtctatttcctgagggaaagcggctataatgagcctgcctgaattatgagaataaagttttccttttttaaagagtttattctaacagataggaggtaacttttatttctgccttcctctcttgccactccatccccagctaagaatccaatccctcaagagctgtcatcgtttttgttgttgttgatactctccaccaagacaaactaaaccagactgagaccatgccattttagcattatgaaacaagaaagaaagcaaaagtcaccaacagagcaatacaggaatttgagatgtacagaggaactgaaaaaagaggagctgataggagcattctctttcaaagctcaatttagtgttccaactacttaaaaccctatcacaatatactctatgccatcagggaagaaaaatgccaattttaaaacattattttcacttttttataaaaggtaaaacatgttaaggtccatacgtaaaatctttccaacacatcagttcatctgcaaattagtagctgaagtctgctcaaacgcagaggaaacttccatttaggtcttgaaaaagaatagagctcattttaaaacatctttatttatttgtgcaacagtgagtttagaaacaaagtatccagtgtattttcctagagttaaaaaaagaaatatttttattgagtacattccaaaacaattaaatattctcttaccccacccttttcaccaactgaatagttttcgtttgactttgaattaccacccacttactgatttacaaactggtcaaattcagcatatatacccacactcatacaaaatgcatttcaggtttccctttttggattaaaaactaaaattttattttacagtgagagctaatttgttaggtaagacacaattaaaccaagaaagataaatctaaacttacttacttcttccaaatttgaaaattgtccatgagatcttcaccaataagctacatcttttccatgctttatgatcataccccattttttgtatgcaaagaagaaaggggactaatatctttgatcataagtgttgagatcctaaattaaatctaagatttggggccttattaatacaaagggagaaaatagttaactgaagatgtcattagtaaaaattttcattaacttctatctctataatttctggcctttccagttttcggttgcatctttctagaaatgcatgtccttttcctagccttagctctgaaaatattgcttctacccataaaatgtcatgttgataatgctttaaatattgaactataaaatttctatatcagaattaatgagcctatttcatgttttaacactgaaaatacattctaagagtttagaacttctttaataatttgtttaaaaagtagttgaaggccaggcatggtggctcacacctgtaatcccagcactctgggaggccaaggtgggcggatcacttgaggtcaggagtttgaaaccagcctggccaacatggtgaaaccccatctctactaaaaactaaaaaaaaaaaaaaaattagccaggtgtggtggcagccgcctgtaatcccagctactcgggaggctgaggcaagagactcgcttgaaaccaggaggcagaggttgcactgagccgagattgtaccactacactccagcctgggcaacactcagcaagactctggtctcaaaaagaaataaaataaaataaaataaaataaaataaaataaaataaaataaaataaaataataaaataaataaaagtagttgaaaccagaaaaaaagagatcatctaacatataggagtagaattttgagatataaagttttactccacattttctttgtcactaatatttccccactattccttgcactcataagcccttattttcagaatttattgtctattatggttttaatatgtgtcccctccaaatctcatgatgaaatgtggtctccggtgttggaggagggcctggtgggaggtgtttggatcatgggggttgatacctaatgaatggcttggcaccatctccttggtaataagtgagctctcactctaagttcacatgagatctggttgcttaaatgcatgtggcacctcctcacctccttgctcctgcttttgccatgtgaagtacctgctcctcctttgccttctgccattactgtaagattccttaggcctccccagaaaccaagcagattccagcaccatgcttcctgtacagcctgcagaactatgagccaattaaacctcttttctttataaattaacttgcttcaggtatttctttatagcaatacaagaatggcctactacactctccaggaagtttcaaatcacgtaagactaaatgttagtattcttactgcaagccaaccagcgtaggttcaccctcttttattttgcagcgagaaaaacaaaacaaaacaaaactaaatccatagagctgattttgatttacagatacattcattttatttataggtatcaggcatacttttttccaagcttcagacctccaatgagaaggcaaagcctaatgtggttcagtcttattacctggctaatttgaaaggcaaaataaatgacagtgaagaaataaaagacagctaaaccagatgatgttggtttgtaaactttaatgactacttattaaaattttgcaaaaaatgaaattggttattatctatatcagtgatttccaatggtggctaccagaagaattgcttgggaaccttttaaaacataccaatgccagagccctgccttacaccaattaaatcatatttggcagtgccaagtttaaaacatacctgaggtagcattttgttaagactgtttaacaaagttatcgagaacacaagctactttcaatctgaacttcatttgcctcatccccaaaatgggcagaataactacactatgtggatattgtgagaattaaatgaaataatgcttaagaagaatccagaacaatgactggctcacagtatgtactcatttgtaggtggtattgctattagagctcctgttgatctgcactggtaaaacctgtaggtgttacagaaaggaaatggtatgcctatgaataaggaaaaggaagaacactctttaaacatcaatcgcagccagcaatgtgctatacccatgagacataggaaatacagcagcaaatcatacttagcattcctgtgatagatgttagccttaatgaagtatcttcatgccatacacaggaccacaaaagcctctgtgggacccaacatacaatttcctataataactcgtgaatcccattcattaaattagtcatattgaacattcttattcaatttctctatatctaatgccaataaactaaaaaacatgtagtatatgttcctatttatatctgcatataaacataaatacatatttttacatatatatgaaacattaaaaaacagaggtaatttttttgtctatataattttcccgtagtggccgaatttcctaaaataagcatacatcatttttataagtaagatgctgatttcattttaattaaacaaataaaaagtcatatatatttaaaaatacaaagaaactacacctttctacaattaatttattagaagtttgtttactggtattgttattgtctgcactgaccttaagcctccttaaagaaaaaaaaaaggcaaacaactaaaatgcaatcaatccagtcaaattcatggtgttataaagttcttcagaacagcactaacatggaagacttttataataggaaaggaaaaaccaaataagagagaaagagaatataaataaattattcagccctccctttcaaaaagtaaagaaaatattttcagaatagattatttctttcattatactactgacatattctttccctaaattctaattctgatcctaatctttttctctacttcttttttctcctcatattttaagattctaagattgttctcaaactgttggcaactgctagatcacttgatgagggttcaacaagcatgtggaccaccagttttagttggaagaatgccattgtttacaatctttcatcaaggtatctcttactggctcaatgataaattgtgtgagccatagatcaggtgaaatttttatccagaaaaataattttaaaacatcttcatttgtactgaatcagaaaatcatgacatacttagaggtcactgggattaatactgaattcgagatggctctgtcaggtagttctagataatttgcaataagcatcaacccagaggttacgaaaaggtttctcactgaagactaccttcaatatgtaacagatgctaagtcaaaaattatattacacacaaacctaaaacgttgaaggttttaactcggaagatggagaaaaaaggattcttaatccatcttttgacagcactcagtcctataaagttgttagaaaaaaaaagtcttcatgttttgcacctggaaattatttttaaatgggcttaataatgtggcatcaattcctttcccccaaaatgagtaaacacatcaaatgttgggtaaaagtcatgttctcagtgatcgttgagccatatgtaccaaaattaatattctaaagaaattctgctatcttgtcctcaactaaaaatcttgttgaccttaaattaataggtcaaggctacttaagaattgatatgtatgacttaataagactacttgaaattataggaatagtttttataggatttacaagtattatgaagaaatagtttttcattttttcattcatagttgcaaaatgtaggttatgaaataactttaaaaaacaacatttccattcatgtaaaaacctccctctccttgctatgggcaagtctggttctccataccgtcacaatgacactttcgcagtcaacatcacagctcaggaaataattattaaaaacaaacaaacaaacacaaatatctattatagagtatgggtttttagtgataagaaaaacaaaagtcatcaagcatttcttcacatattcacagaacaaatgccaagagctgatttagaccttccaacttaaaatttaattatctgctaccacatacgttagatggtatctgtttttccacagtacagtaatatgttgatataatgcagaatccaacaatttggtatgataaaggaattttatcaatactttcttctgctttctctctgaacatatttgtcatcatctttgaggctgatttaccagttttgaagcaatcctgcgcattacttgtaactgtttttgctatgaggagtacaattctgaatgaagtctttgtagttttgatcttttcacctttagtaataaaagtcatctattttgtaccagaaaacagtaaaatggcaaaaacaaaaagtttcaatagcttcctttgattatttgacaaagtttgagaaaagacaacatacttggaaccagaggaatcaggaagaaaaaggactgctggtatttgtcagtgggctttctatttgtgcttcttaagctgattgtacgaaatcctcacacctccatgttcactttacccagcacttattaaatgtacattttattgctccagaaaactattcactatttatacttataatcattattgtacattattgttagaattttcatatttttatattttaatgaatctcctttaaactactgatgtatttttgtgaattggaaatacaacagaaaagtaacaatgaataatgcaaaatttaataaatgtaaacaatctgcaagttatgtaaaacatattaacccggacatattatatactgtatcctgttaaatgcctgttggttgagataaacacaagcaaatcagtttcaggatctaattggtggtgaacagctttcactatagtaaagttaactttatgtataacgaaattgtttacaaggcctgcattccacacaatgacctggaattgtgacagttcctcagtcccagagatgctatattcatgattttgcaataaacaaaactaatacttattaagagctaagaaaattttctggccgggcgcggtggctcacgtctgtaatcccagcactttgggaggctgaggcaggcagaacacgaggtcaggagatcgagaccatcctggctaacacggtgaaaccccagtctctactaaaaatacaaaaaaaaaattggccgggcgtggtggcgggcgcctgtggtcccagctacttgggaggctgaggcaggagaatggcgtgaacccgggaggcggagcttgcagtgagctgagttcgcgccactgcactccagcctgggcgacagagcgagactctgtctcaaaaaataaaaataaaaaaagagctagcaaaattttctaaattaaatcctaaatcttttcttaattgtatcacatcttcacatacacacaaatctactatttctatctcaattcagttagctttatattcctgaattggtttgactcagatagaaaagttcccacaacaactcattttgagaccatttcaaggtctgcctatttaatgtagtttaaatcctatgtcaaagtcagggccttgggtttatataatttatactgataaatcataatgataatcataataatatctcaacagaaatgtctgtcatttcaggtaagataaataatcttgactaaattaaaacaaatgttgaggtaattattactatgtacatttgaaagcaaccataagcttcacaaaatgaatcaaattcacaatcgctactctcacaaagtttatgtattaaggactattgcaaaagtcatccattagtcttttcttacacaaataggaagtgaaaccaatgatttaccctttgtttacaaagatgtgactatttttaaattgttatttacatttaaattgagcatttatttagcacttgtcttaaaacagtaatttttggatgatatataaaagagtatttattaaagacttctatctaaaaaaaaggatttataccaatccatgcacatattagcttacttctacaacctcacctttcacaggtacacatacttgaacctccaaacttactccattcatactgaactatgtgaactatatgcaaacccatgaacgggtcatatactttttttttaatgctaaactttttaataagctgtttctcttcttataaaacccttaatacttgtaactggctaattcctactcaccttttcagtgctctcttagccatcatgtcctgtaggaagtcttccctgacttgggttaagtgccccttcttgtgactctatacctctctggtatatagagagaggaattatcactcaacagcaattattataagatattgaaaatgtccagtgcccagcctgtctctcccactataccatacattctcaaagaaaaggagtatctggtggttacttttttatttctagcatctagacaaataacaagtattgactaaataaagtatatttcagaatacaagttgggtattccttgtccaaagtgtttcgtatttcagattttttcagattttagaatatttgcatacacataatgaaatattcttacaatagaacccaagtctaaacacaaaatttatgtttcacatataccttatatacgtagccttaaggtaattttgtacaatattttataataattttgtgcacctctcaagtgaagttaggtgtgaaattttccacttctggcatcatggcagtgctcaaaaagttttggactttggaatattttacttcagattttcagattatggatgttcaactggtataaggcaaactgtttagtcaatgttatttctcagaagaaagactctcatattatgggccacacttccaattactttcttataaacaacaaagtagtatttaggaaagatttattagcaaggaattacctcagttggtactggtttgtcatggctttagaggtcaatctgctagaatagttaaaaatagaggcaaaataaaatgtaatacaagtttagtttttatttctggaatttttttcacaattgcaaatgttagctgctgatttaaatatgcctttcaaacatcatataaaacagccaaaagattatatcattacatagtacagatcgtaaatatatgcttaaggaacaagtgttgaaaaaaattcccctagtgttatggaaatggtatttgtgtcttctgatgaaattttaagtgacagtatcaaagatgaatttaaaacatgttataactaaaataacttaggtaaaaccaaaaatgatgtggttcggaaaacattgaaaaggtacgaattttataaatgtatgtgacgaatatgaataaaacgttcataaagttaggattgaaaattaacattagtaaattaaaatattattttatatgactttagttataattatgtatatgctatgaaattataagtaaatatttgtctctcatatctaaagctcccttcaaaagagtttttttatgataaaatataaaattcattagcttagagttatttgggggcatgtatgacatttgataaatacatgattaagtgaatgaattaagctctcttcatcttagaaatcaaaactagaattatattatcaaacacctttatgtttgtttatataaaaataattttaatacattttataaattatgatactttaaagaatgtatgcattcctaggggtcctctgaatctctcaatgatttattaacttttatttcactttctataatccctaccataaatattcagtcacataccatctcacgcatacaggcataactggcatgtaaacttaggtaacttttcaccgaaacttttatgtgcagatgacagttctgattaaaggctatgatcaatatgtcctctgatatggacatatggttaaaatatcactgtgtagttttccctacagaaaagggtaataataaaaggatggtaataagatgaaaggtactctacaactctattagaaacaatagaaaaacaaagtcaatccaaaatcataggaggacaaaattacaaactattgtttttaaaataatgatctatcattttttagcacaatcttcaatttcaggtataagcttcaattcctatactcagaaattccaaaacgctgttatttaaattattaatgatttaacggaaattttataatactaaaacttaaagcttaaggtatcttggctaaatttttttgctaggtacattcattcaataattcattcagacatttaggtaataattaaatgactattaaagtcctactatattttgggtagtatgttagttcctatggtgacaatgagaagaaaaaagcagacacaattccgttttcatattactaatgccttgtgggaaccagacattaatcaataatcataaaattattatataactataaatagattttggagagaaaaatgagattccatgatagcatctgaggaaaaaaaattgacatgcttaagaagatttcactgagaaagtgatgtttaagctgatatgatagatgggtaggagtttagagactagcaaattaaagctaatagggaccaggattaatattaagaggttcttttttaaatgaatacataggtattcataggtagtaagagctgttgattagtaaattgttgggacaggaattaacgttgttacagtaataccttcaaaatagtttgttttcctaaattggcgagaaatcattctagaaatgctggccataggatctttgtgtttgacaaacccgtgttttgtaagacaaatttcagcaagttctttttccaattatcataaatttagaattatattttctgtcttcatccagtttcacactgctctaaagaactacctctgattgggtagtttatgaagaaaagaggattaattgacttaatagttccacaggctgtacaggaagcatgcctggggggcctcagaaaacttaaaggtgaaggggaagcaagcatggcttactatggaggagcaggagagagaaaatgaagagggaagtgctacacacttttaaccaaccagatctcggtgagaactcactcactatcatgagaacagcaagcgggaaatttgcacccatgatctgatcacctcccatcaagtccctcccccaacattggggattaaaatacaacatgagatttgggtggggacacagagcccaaccatatcagtgaaatcctaattgatgagactttagccacaatttaatgatataataaaactttctaaagataaaagtgtggttaggcatggtggctcatgcctgtaatcccagcactttaggaggtggaggcgggcagatcacaaggtcaggagatccagacaatcctggacaacatggtgaaaccctgtctctactaaaaatacaaaaattagctgggcatggtggtgcatgcctgtaatcccagctactcgggaggctgaggcaggagaatcgctagaaccaggtagttggaggttgcagtgagccaaaattgcaccggtgcactccaacctaggtaatggagtgagacgctttctcatggaaaaaaaaaaagtgactagaccacagtactatcttgtatactaaagaaatacagagttaaagagatgagattataattatattgcactaataaatggaaattcgtcatctttcctcctgcaaagtttaactaaaagacaaatatcttgttcaggaagaagcttgtcaagttttcattcctatcactgattatcctacaaacacacacacagacacaaaagtgagctaatttaagaaatcataaatttaaattactgagagttttgttataatgtttgaggtatatctaattttcactataaactgtaaatgctattataggagactcagaaaatgcaaaaagctagaaatttcagaagataaaattattcagaatcccatcactgcaaaatgagcactgtaaaaattttcatgtttgaattgtttttagtaataataattttcattctttaattgaatttttaattaatttcaaaaaacgtttatagctaatcaaactctctggtcattcagttttttgtactcttcagtaaagtccacagtaaaggctaatctgaatgctgacatcactgcctataactctctctgttgtggtttagccattttagctcccctttcaagaacagtaattccccctgaactaaatattgttaaccacagataaagaagtacaaaacaaagcctatgttgttttcctgtgaatccaaatgagaaataacgactttaaagcatttgatctatccctttaaaagatgtaacacattggagactataaatcttctccctataaatccaacagagcttttcttatccttcatcgttggaacagtttcttgtttgtttgttttgctttgttttgtttttatttcagttcagaaccatataaagtaactgaattggttttaggtcaaagctatgtattttttggtgtcatcaaatattagaatcactcagaatggcaagatgctcacatcctgagaagtaaacagggatggaagccaaccataactccaatctcactcagggtggtgagttcactaatcagcaagagcttatttaagtggaatagtgagagtacttgctcaataatttgataaaaatttcttttttaaatgaatgcatatggttaaatttgtgtaaattaagtatgtgtatattaactcacatttattgatgagattctactgtatttcatcccaactttcattagaatacatattctttctataatttaagaatttccatattgaaacctgcaaataatttgttctctgcttatattatccgaatgccctataaacctgtctgatacttaaattctgaatgaaacttctaggagatgtaagatgataatatccagaaaaataaagaggaaaaaggatgaaaacaacagaatgtgtcggtataaggacatgttacaaagtttttactgggtttagtctgtggttggtttatcattatattgcaaaaaactctcccataaactactaatgattgtaattcctattaaattgggctttcatattaaattgtttaaattagttctttactctgtaagcataatcataatccattgtcccccattagtcaatttctgctttgtaaaattaaatattctgaattttaacatgtgaggcattgaaatatacaatgcttttcacatacccaagacagaaagcctatgactaaacttatgaagaaacaaactatagagaaatagctgtgaaaaaatacttcttattgtgataaaaatatcaaatgatctgtttacagggagcaataaaaggcaccatttcaactttcaacataggttgttccttttcatttgtatttccaggaaagcgctgaaataaccaatagtcatccagtttaattattctttaaacttttttaatttaagctcaactatttgaatcatagcaagtttgtaagtttcacaaccaacgtcttaatattaaaaatgaagaacttaggcttagagagattgtatgaattatctcacatttttgcacttactcagtagcagcattagaacccaaactcaaatcttttccccgtcaagtattccattagaacactacagcatgttctattttgagtctctctaggctaagactacatagttcaagtgaaaattaataatgcataattaattatttgccaaacaggaggaatatttaaggttaacctttatcatgcaagcaacaattacttagataatacaaaatcaactgatttgacactttgattattataaatcacaaaacaaataaaaaactaggaatggctcccaggttggcccatagagggattattaagatccctacatgtattcataaaagtaatgcaataattttgatttttcttagctctttatgcttttcacactcaatattttactcttatagtgacttacaggcatcaggaaaatgcagaaattaattataagaagtgttaggacttgcctcaattctcctgctaatccatgtagaaggtcttcaacctcaggtctgagttcttatagaaatcaaaacttttataggagtccatgctttcctgacaacagacaaacattccaggggttccttgagacaaagccatgtacacaatgcaggtcccagtttcttggacttctttctattatcactaatatatatagccatagagtaattttaacttacaaacttttgctccctccaacttacaatcttttgctccctcctggtaatctctctctctctctctctctctctctctctctctctcactgtccactagccttggaagaaaccaactgtcatgtcataaggacactcaagcagccctacagacaggactttgtggtcagaaactgagacttcctaccaagaaccataggattaatccattttggaaacagattattctttagatgaccactgacctggtcaatatcttcactgcaacctacaagaggctctgaactagaagcacccagtaaagcaggtcccaaattcctgacccacagaaatagtgagataaatgtttgttgttttaagctgctaagtctgtggtaatttgttatatgacaatagatagcaaacacccactatgagaaatccaggttaactactgaatctgtttcttcaccgttacaatgagataatagagatataaatatctaacatatcgcattgttgtaaagataaagaatataaaaaacactgtccctagaagacagtaaaagctcaatgaatgtcattttttatttttctattaatattataactatcattatcaatctcagaagtttgccatgtttcataatcttttgctggctcatgtttacttcattagctgagcaagtgaaattcatacactaaaataaatacagataattgaaattaattatagagaacagtacaataaacgtattataagaaaacactaagaatattttcatagctttggggtagaaaaatgttccttggcataatccaaggtaaagaccctcaaaaagttgagagatatgactacataaaaattgaaaacatctttagagtaaataattccatataaaagttagaagtcaaatgccaaaagggtgaaaatattttatatatgtcaaaaagtgagtatctttaaaatacagtcttacaaaataatgagagatacatataagcatgtatgggagtgtgtaaaacattttttacagcagaataaaacaaaaacatgcaagtaagtgaatggaaatttcacagtagttcaaatgactagtaaacatataaagagatgctcaaaaaataaaggaaatacaaaatgaaaaagtcatgggtatcactttttaccttggcttagactgaaaatgtttattatcgatgagagggtagagaaactagcacaaccctgtgagaggtaaagaattcttgaagagtattctggcaatatgtatcataaccttatatgtgctccctcatgcccctgcaacctggcaatgattttatcctaaagaaataatcataaaagtcacacatgatttgcaaagagtcatggacactgatacacataaatacttgaaaaacaagcatctttcatatttttgcattttaacaagttagcttatagaataatatgtattatatgttgccatttttgtattttaaaaagtgtcttctcttcaaaagttattttaaaaataccgaactatactaatgattgcgtgagggtatgtggatagcatcaggaggatcttctgtttatatccagaaaataataaaccataaagctacctagttgtttaatagtcaaatcttaccatctcaattttatggtacaccatttatgtaagtggttatccatatttcattatagggtgtttgggcttaatatgagaaaaggaagagcaaagaagtagaataaggaataatgtactctctttatttaaccagaaaatatggattgagatgtagctacttaacaataacaggtttgtgtctaatgagagcctcaaggagttggagtcattctgttgtagcacatatctattccagaatatatgtgcttgtataaattctgttgagaataaaaataatctacatactctaattacttaaacataattttcaaaattattatagagtcaaaacagttaaccccttttcattatccttctgtcttctctaacacctctggtggatgagctgctattgcaactgtcattgcaattattgattgcaatttttgtcattgcatttattgatataagaaagtttaaatccattaactttaacttcgtatttcttttctgtcccatgtgttctttatttttttttctctttgtctgcctttttttgaaatagttgagtattcaatgttccattttatctctattttggccttactgttatatctctttattttgtaatgattattgtagggtttacaatatgtaacttttaacttatcaaggctaccttgaaataataatataccacttcatatataatatcaaaccatttcaacaacacacttctatttccctgctccaattatttatgtaatttatgtcaaacatcttactactatataacccacaatacattgttaattattttgctgcaaagtgttaccttttaaataaaattttaaaagaaaaaagtgtgttatatttactcatatatttaccatttctggtactcctctttactttgtgttattacaaatttccatcttatttggtatcattttccttcttcctgaagaacctccattaacacatcttgtagtgcttgtctgtgggtgatgatttctctttcagcttttatgtccccaaaagtctttattttatagaattctaggttgactctttttatctttcagcattttaaagatgtctatattagtccgttctcatgctgctaataaagatatactcaagactgggtaatttataaaagaaaaaatttaattgactcacagttcagcacagctggggtggcctcaggaaacttacaatcatgatggaagaggaggcaaacacatccttcttcacatggcagcagcaagaagtgctgagcaaaagggggaaaagccccttataaaaccatcagatcttgtgagaactcactcattatcatgagaacagcatgaggtaaccactcccgtgattaaattacctcccaccgggtccctcccacaacacggggattatgggaactacaattcccgatgagatttgggtggggacatagccaaacatatcaatgaaattctaagtcttctagtttatattgtttctgacaagaagtatttaatatttgtgtcttcctcctgtacataatgcctccatttcctgtctctttctgggattttcttgttatcaattgttttcaacaattttagtatcatgtgtcttgatgccatttccttcatttttctcctcttacttatagttgaaatctctagatctttgtaaatacagttttagtcaaatttgaaatattttcagtggccaggcatggtgggtcatgcctctaatcacagcactttgggaggctgaggcaggcagatcacttgaggtcaggagtttgagaccagcctggccaacatggcaaaaccctgtctctactagaaatacaaaaattagccgggcaaggtgggggttgcttgtagtcccagctactcaggaggttgaggcaggagaatcacttgaacccaggaggcagaggttgcagtaagccacgatgtgccactgcactccagcctgggcaacagagcaagactccatatatatatatttcagcctttgattgtccaagtaatttttcttccttccttccccacctcctttttaggactaacatacaggttaaactgcttcatagtgtcccataaatctctgaggttatatttgtgtgtctgtttcaatcttttttctcagattgtgtgtgtgcttcagattggatagtttctattgctatgtcttcacattcactaatcctttttctgtagtatctaatatcctgttataccataccaatgtagtaaattttttcattccaaatatatttttcatctctaaaagttccatttagttcccttttatgccactcatttctctcctgatcatagtcaagctttcctttaaatccttgatcacatttataataatggttacaaaatatttttcttctaattccgtcatctctgccatttctgaacgttttttcattggtaatttttttcccagttacatgtcacattttccagctttttcatgtaacataaattttattttgatgtcattcatcataaactttttgttgttgactgctgaattttgttgaacttcacaaagtattagacatttttctggcaggctggttaatagcttgcagatcagtttggtccttttgagtcttattcttaagctctattagggcaggcttgttaggccctactgaaaaagaattatcctttttgggatctcatttccctggctattaacaaagtgtctccactttggctgaacaaaactcaaacacttccaatccgcgaaagctccaggagtggttcaccttttcagctctctggttgttctttgccggccttctggaggtttacccaaagtatgcacagtttaatattcagcattcaataggctcaaggcaatccttttgcagatttccaaagttccttgtctgcatatctcccttcctccggtattctacctgcaaattctactgcctcatctccctgaatttcaatttctatctcctaatctcagtgtgatcactgtgctctgtttaggtttcccttctgtacattatgatcaggaaagtacatccaagcataaaattttttctatgcaacagaagaagatattatttttaagtgtatacctctccctattatgtcatacaaatttcagggcttattttcaagaaccatgtcttttatatggtatctggttatgttgttactattttgaaataaaatacaggaattgaatttattcagtgtttcatctttgaataacctgaaaattgtatagtaattccttatcttctcacccaaaccactgatatataaaatactatttaagacgacaagatcaaacaaggtcacttactatcttcctttgggcatacctatattttagccatgcttaactttgtatcattactcaaacaacctcttttaacacccatcttcttgattctatttttaagagaatgagatctatggtaaactgtctaagttcaaatcctgacccaactagtttataaagcaagttatacttaaagcatctttgacttcatattatcatgtccatgtagaaataataatatagtctacctcaaaatgattatgaagaataaaagaaacaatatacagtcaatgaatgtgagctaatgttatcacttgcaaaccttttccctatttctttatatgcaaaccctatccgtaattccatttcagttaaaatgccatctctacaggaaggctttcccgggatccatgctgagaggattctttcttaagatactcatcacagggcatttatgtgatttatatttttcttcttagcttctatactaagcaattaagttcttgaaaggagcttccatgttttactctctcttttttcaaaaagatatcccacagtggacagtaaattgctttgtatttagtaggctattcacaaatacttgcctcagaaaagaaaattaaacatgactatatgggggaagtttttcaaataacttatgaatctccctaaatctactgccatcattttatcaaatcccttgtttacaccaagatacatatgtttgcaaaattttcttagctaacaacccagttaactttatcagaaaaggagaaatgagattagtatgacatgacttgttcttggtaaaataacaccttggtttctacatggtcacaaataatctattcaatatttcagaattttgcaggagataaagttaactctgtaggttagagaattcacctttatttcatctttaatattttatatgtttgcttgtatccattattttatatcttccgattctccaaatatgatcatttctggaagttatgatgttcagtcaaagaaagtttagactttggagcaaaagtccttaggtttggattccagttgttctgatagacagcagtgtggcttgaaaaagatatatttactttcagttaacacatctataaatggagataataaaattttcttggagcatggtgattattaaatgagaataagtgaaaaggtatgacctactgcctactgctaaaaactttttatttgcttccttttggtttcctcacctgcaaaatgcaaatagtcatccctgtttacttttcaggattcccttaaggattcagtgaatacatacattgtgatactttgaaaaacacacattatataaatatgcaagtttttaaaaaaattatggtcattattattcttgaataaaagttaccaaactctgtggacttagattgtaaatttgccaaaatagtctcctattaaccaatttattgatttccattcatttcttctaatttgaagattattcttcttggaaagaaaaatataggcaaaatatttgttcatcatctctgccttctctgtgtcatctctgaaaattatgtcatattctcccaagtaatgcctctatctattcagtctgaggtgacttttcaaatctcttctaaaagtttacgattttacaagagtaaattagagtgttcttgtacacacacacaagagaccaaaaaaaatcagaacacattttcacaaacagctgaaactatttaatatgggtatccttaaaaacaataaaatattatgaacagtaaaagtcaattatttattttatgacagaaatatttcagtgtgattatatctgagtatatcttcaattttttttgttcaggcagcaagcattggtcctttttaccaaccactacaaattatgcaccctaaacattatgcactctatgctataaaatgacaatataaaaatataatccaatctacattaattgaacataaagtacattctgatactcagcttagactaaccataacacagaatttgtcattaaacgttcagttcacacacatacactcaaaactgatccaacaactcctattatgccagttaccagcattgccagcccctttgcccttcactgcctggagaacgtccatcagaaacagggaagcagagcaaactgccacaatgcaccattgatgtttgagcaaggctgcctaagcagctgcaataacagggcaactcttcaaagtgtcagcattgaaacttacaattctctctcccatacactatcaatgaaaacctttataagctacaatcaattataaaataaatctttgagacaaatcatgttctttcttcatttcttctctccttcttttcctcccaaaaccaaatgtccttggttaaaagaaaaattcaaggagaaatatcccccctttctatcttggtctctgcctctgcctctcttatgtctaaaaattctctcaaggaggtttaaggatatctgctaaacacttttgtttacaagacaagttctggggttttttgtttgtttgctgttgggtttttattgttggaatgtttttattttaaaaattcaaaaggcacttgatattttgagcacactcatactagatttttggcaaagcatgtttttgattattaaaagacaatctaaattctgaaatgcatgcaccaaatcacataacctccatatttttgtaaaccacaacaaaagtgcctcatattagctacagatgaatagctaatgagtcagcaaacagttaaaaacattccatgagaatagatgcactagccatgcaaagtttttgagggaaaaatatattaagtatttaaaaactacttagaatgaagggaaactattctttctttaacaaagcaactatgtttaatttgtcttatgattatacctaccaaaccaaatgaaagtttatctgtctttttctatttctccttagccatcaatagttaatgcctttttaaattttgtaacatatatttaaggtctcagaattgtagcaacaacttttagattcttcatcattgtttttatcattcaaacagcatgcgaaaaccccttcaaatataatgtcaaggtataactctaattcctgcagataacaaaaatatatacacttcatcatgagttaatctactacctgaacaatcaaagtccaaaatacttggtatctgagttcagggtgcaataataataaattgccatagacttggttaaacaacagaatttaacaacaaaaatgtatttctcacagttctgagggctgagaagtctgagattagaatgccagcatgaccaggttttgatgaatgcctttgtcctggtttgcatatagtagtcttctcactgcgtcctcacatgatggagggccaagagacagagtggaagcaagcttctataagggcactattcccatcttgagggccccaccttcatggcctaattacctaccaaaggccccatgtacaaatgccatcacattaaagattaggttttcaatatatgaattttgaggtgacacaaacattcagctcatagcatttagaaatctgtaagaatttttagttatcatttctcattattgtcaaagcaacacacacacacacacacacacacacacacaaacacacacacacagtttaccagttaaatagtaccacaaagtttatacaaaatacagcatcccgtatccaaaactttgaccctctgccaaaactcattctagtgtttgcctgatttctaaataatatgcttctattgttatttttatttataaattttagacataatatattaacttcctatcatggcagaagacttagttctttgatactacctcatttccctttcttccatccttccagtaatcagtgaagtaatatttttgaatacatttggtaccttgagtagtaacaatatttccttcctattgttaatattgtcactttgccccccacattcccaaggtttgcaacagaaatgtaaaacctctataaatataatatttcacactcttacacatgaagaatcctattctaattctttcccctgaagacatccctttcgggagttctccatcttctagctcaagtaaagactgcttatttttaagatcaatgcacagaagttatccagtaacttcccttcacctttctcacctcattttaatcacctgtttcctgaaccctctatcttggtcttttctcctcagtttttcctcacttggacgtagcatacccttgaaacaattccggagaaagcaagtgtgggggtacatttggagaaccatgtgtctaaaaataaaaatgttttttctacccttatacgtaattggtagtttgggtgtagaattcaaagttaaaagtaattttctctcataattctttttttttttttttttttttttttgagacggaatttcgctctcgtttcccaggctggagtgcaatggcaaaatcttggctcactgcaacctccgcctcccgggttcaagtgattctcctgcctcagcctcccaagtagctaggattacaggcatgtgccaacacacccagctagttttaaattttttagagatgaggtttcaccatgttggtcaggctggtctcgagctcctgacctcaggtgatccacctgcctcagcctcccaaagtgttgggattacttacaggcgtgagccaccgtgcccggccttctctctgaattttaaagccacatcttctagctttgaatgttgtcattaagaaatcagataccattctggttcttgagccaatgtatgaggcctatatttctctcgggaactttctattatcatctatttattactgttattttgaaattttccaattatgcatcttggtgtggaattgctttcacatttttatgggcactcagaagatccttccaaactggaacctttggggctgaaaaattttaccatatacttttataacagtttcctccctatcattttctttgctctcgcctgccttctgaacttcccattaatcagatgttcagcttgttggatcgtttgtttgatttttatctcttctctcctattttccatttatttgacttttttttgctctattttcaggaaaatttctatcatataaaagcttatttcagttattataaaagtgcttattctctggttatttcttctttttatataatcttgtcatgtttcatagtagcagtatcttctgctatctctctgagtatattaattatactttatttctacttcagctactgttttctacaggacatactgcctctaattcttaaacaggttctggagtatgaactgtcttgtttctcattgacacaacactctccagtcacatgtattcggctttcccatttctgccagttcctcctttacatcttccaaaagttgtgtctctttaatatgttgcttcctcttccttatgcctgtggatttatatattttttagtcttttgctcaaaatttttagtcccttactaggaaggaacatggaaaaacatgtgttcaatcacgaagtttaactggaagtctgctgttaaatttcctgaagatgttaatcctagagctataatcatgctattcacagggtcataaaatcatagggctcttactataaaaaggttatcagagatcatccgattcaaccctcttattttataaaagtgagaaaatggaaacccaaagaggttaagtggtttgtgcaaggttatttaaatagcaatccatacatttggtatttgacttgctttcattaccatagtgcctcctcaaatagatatccccttaaagtagtgactcagaagactcccagacacatcctagggttaacacatttgaataagccaatctagcttttggatataaaatggaggagagctgtcattaaagaaaatctgggaaaaaatgtctccaagaataaatatttgactctggacatcctgttttctactagtagaaattccctaatcaatactctcccatgaaactcattccccttattcagcttcagcataacacacttatcctaacttttactctttcaggttacagaatcacatcatattttctcaaagcaaggtaaatctgtgtttgaaattcaaatgaatcttttatatctttcctaagtttctaccctcaattccttcctgacctctggctggccaccaacctcctactcctaaaatagtccttttttttttctgcaaatggcaccacccaggtactcgagaaaaacatcttgagagtcatcctaaacttctctttttctttaacagcatccaacttccaccccttcaccgatacagtacccaaatcttatcaattctacttcctaaaaatcccttgaatccattcctcttaggttcctcatagcttcacagtcactgtttcagttcatgccctcactatacttcaccctgatttccattaattgtcttctaacagtctcacagactctggtctgctttcttcataccccttcttccacactcaattgctgaagtgctttttctcaatagaactaagaagtcatttcctcacttaaaacccttcagaggatcccacctcatttctgacttcttagtatagcatatataaggcacttcatgataggcacctacttatccctccatcttcatctcctgtggctcttcaccttgcatgttatggaactagaaatcagaaaatcaaaagtctcctctcgggtttctattcacactggattttcaacaccaaatgccaaatgtcccttcccctgtcttctcccaaataaaggaatccaacaaaagagagtgaaaagattaaaaaccagttaaaaccatttaaaattattaaagtgcttttaccataatattttacatttatatttataatattttatctttatcttttagggattatagtctgtttaaatatgttggtagtacattaaattattattcagaacactgaagatgtaaattaaatatgaccataacaataataattagactcttatcatgtgaaataattaaggaattaacacattattatagtaagggccaaatctaagaaatgtactataccataccaccagactgcacacttttagtagacaggactgtgtcttaatcatctttacattccctactatgccaaatactatccccaacataatagatgcacagtgaattagtaaatgattaaataaaattagaaataatatcacacccacaaacccgggaagcaattatttgcctactacttgatgaggccaataattcaatgatatttattattatagttgatcgagttagtcaaatgtcatgagtgcctcttaaaaaatttatatatatacacacatttttctgcagatctttatacggaacatcaatctaatctttatttgggcatataaatcattcaatggataacacagtgaaaattttcaacataacagaaagacatatgctatttgaaaaatcagtaaaaaaaaaaaaaaagatgattctattgttggtattcttatcttcagattgtcctccacagcacatccctctgatacagagaaataaaaactttcttacctagaactctgatcaagttactgccttttataccactataatgatattcaaactggcttctaagcaaaatagaacagaaacattgcacatgcacatgcacttgaattgtacacttcttctatcgtatcaacttcatgtaccatgatatgctcgccattaatatgcactaaagctaacttgctagcctgccgcaattttattgttgcagcaaaacaatagtggtggattaacccatcacctcaagtttagcaatacatcctggaccagttatagatatgcattaatccacaacttaaaatgtaaaatatcaaggagctgggccaatccaggcatatgagtcaagaacacagcacttcaaacatatccaaactgaaactggttcttttctctgcctagaaaggtacttaacaatgggttctgaatatcatgttgactgacaggtatgtcatataaagaaggaaatcctcttaaatcttacctccttaaaaatatcaggtttaacagaagagtatgatgtgtagatccctactagatagaagcctgaatacctaacccattatataaatagtatgtattgtatagtatataaaggctgcgattttctgggctgctgcctactttttatgttttactgttgtcttcatgtaaaataactgtatggaaatggtatacctaaagagacaaaacgggtgaaatttaaatcaaccaactaaagaataaacagtataggttaaaaaggatacatgttaacaaaatgatgacacacagcagaataaagaaaatatatgaagaatacacatctgagggcaaaaggctgaggacagttgaaattgatagaatttgtaatgactgaaataaaagcacaagaaagagtagagaagaaacttgaataatattcatagataggaatgaactgtggaaattccaatgccatgataaggcacgatatagaatgattgtatttcttttatccaaaagcttcacgacaggtaaagatagactataatctgaagaacaaatagacctaatttccattataggccccgaaagtgaccaatagtgatacttataatatttaagaaagcaactgggcacttaactttagattataccatttaaatttttttcaacttgggaaaatgtttcaaattccactttgctacctacttgctttattttttaaaaaattagaaaaatgccatgtaaatcactgtagatagtattgcattgcttgtttgaaaaaaaaaaaagttgacagtttgatagtgcattcattcttatgcctccagcactgaatcaaccactataacattcaaaccaagaggaaactttcagcagtcttgatgctgtctcctactctgaagtgtgagtctcttttctacaaagagcacatgcttagggaggaaaacaggatatgaaattacacaaaaatatgtgccccagcattcagaaagaaagcaggtaaaagcttaattctcctccaaaaaaagcagtttctaaatgtggattcattaatgaaaacttacaacctagcagtcagcagaagcatttaggaatggaaggcatacagtacaatgccaactattagaatcagtgttctactaccacacaactattctagcttagctaacagtcttttttgtcacgacttttgtttctttttcctttgtttcctctgttttcaatcgggagagaactgtgtgaagctgagtgttcgtttaagtcagaaacacgttggctagatctaggttcagtgtgggtgagtactgtgtaagcattccacacacctccactaatatgccacgaactctccatatcccaagctttctgataggattcagttgagactacacatagcgcttttacttatgtcacacatgtgatctcaggtctcagcacgtactgacataggtagttaccatcaaacttgctcttctcataaatcctgagaaaaaaaggtaggttggaggtagaaaatggacagaatgtctctgctaacctaaacagaactagtatgtgttgctgctaaaatattccaatagctggcagcaatgatccataacattatatttgtaatataagtatacataaacactacaacagatgatctcagattgtcattgataatgatgatggctaactttttttagtatgttacttgtaccaagcattgctctatgtactatacatctcatttaatcctcatatacaaaaaaaaaaaaatattcttgggtaaagttattttcattttcattttacacaaaaggacattgagatacagaaagaaactgaataaattgattttaacatatttaacttatttaaagttaaaacatgaaattatttactaaccctttgatgtaggaccaatggctgtcactgactcttgatctgctatataaagtttcatgttttccttcttgcttaaactacaccatgatgtatcacctatgatttcctgttttggtttatttaaactcaatgacagcttaaaggtacttggaaagcaaactgaatgagggatccttccagctttttacattttttcacccctacctcaggcaatctttcacagttgtctagcccacacctttttaaactgcaatttgttttagcaactcacctttaaaaagtctttccaaagcaccaacttaaatttcataaaatcaacaactctttatatttttgaactcatattttatcagtttgcataattaaattacaattgcacattcatttggcataaacaaattcaaaaacaaacacaaatgactgtagataagcatggcagcaggtaaacagatgaacagaaacacaccattttttcagagtattctgttggccagaagcaggaataacctaagagggagtctactgtatacctaccatttcctaattataaacaatactatttaataggtatattagctttctggaagaatggatttaccatggaaaaatacaaacaaatttagcagggaggttcacaatgataccaaaattctacactagaaaagtaatacattccttcttatctttctttaattagaaattgtaggagacttcttcactgacaaaaactaagagcacaaaattccaccccaaactcaattcagcataagaagactcctacccaaagcataaacatatatactcacataaaaaataaaaaaaacttttaaaattaataaagaaattaaggttttaagaaagaaactttctccctactagagaaaaccatcacctcttggtggggaaaactgaatttaaagttcaggttcgggcagttactacttatgtgatggagtaaatcaattcacctcactgagctatagtatccttttctgaaaaaaaaaagataataataatggttctctcctcacaaaactgtagtcagaattatataaaataaaatatataaagacactctgcaaactatcaatcatcttatacatataaattgttattactggaaatcctagcttatattttggacagagaatttcagagtcaagggaagtcatttcacaaatgacaaggctgtgattcaaaagcctaaattactttcctacttacagtggcatggatgacggagcagaaatagagaattcttgattaaccaggagaagaatatcataggcatgggtgtgagatcaactggagattcaaggaagctaaagtgcccagaatgaactaatgttgtaatgtagactgtgagcagagataaaattccagaagccaaggagtgttgtacggtaagtcctggcagtgcctttggtgaggagagtaaagaagaaatagaaagattagccaaaaaaaatttcaactataccaaattagtattccatcctgcacagtaaaattttgatgcctttacaaactaaacaaagtagggaatttaagataattcccatgtttatgctgtttctttccactggtcagaataattaaccataggttaggaagttaagaaaacaataggatagacgtcagtgaagttcaagtgctttaattggattcctttgggtacagtttgtttccctttttctctgaccattaatccagcagaggaaagtgatctaacacagcaccatgacatgaagggacggaccctgagagcctgtctctctatgatgactgttcttgtgcatccaggcagcctattgaaactaacaatgcctgctgctgctgccgaagaggatcatccaaactctgaaaatgaaacacatcacacaaagggatgaaagaattcttattccacagggtttagcttgcagctggtcatgcatgccagagggatgtgccacgaggatgacaaagaagcttccaaagagaatggaaggggcagccagccggacattttgaaatacttagaaaactattcttttgaaactaaggcaataaactagacttctttatggcagaacttgagaaatatcagggtttatttcttttatctctgcaattcacccacatttaaacattcttgcgagtaaaagaaatttgaataatttctaattggttatacagttttgagggtttcccattcataagagaccatattatataattgattattttttcctccgagttgaagctctatatcaccccagagtttaaaactgtatggaagaataggtattgggcttttctgtaactgatgtagatacaatgaataataaatatgcttgttataccaagtagcatgctggttaagatcacagactttgaggtctcagtgatgtaactgacggaatactcattgcatggcatcaggtctcatgggttctaaggatctcgaatagctgtgtcaggtaagagtttgcccacaggaagtgctccaaatagaattaagagtcataagaacctgccatacagctgccattgctcttggcccctcagttggtcacagcaacgcataatccaactcttaagctgccttggatatccatgtttaaagagggtcaaaagcagcacctaaagttttgaaagacaatgctgcactggggcatcggccttttctgattaagttcactcattcatagcaatctaaaaagaacactggctctccctctctggcccttctccactactgttccaaaaagctcaccttcctctgtttacaggataaacgtgaaaggctcttttcattgcccttaacagtacacacaatagacttggcaatcatttctaccaattacatcaatgactcatatgaactctgcataaccagatgcgtgactttgtggaagttatttaatctcatttagccttagattcctcattggtcaaatgaaaataatatctgtcttatgagattgttgtgaagaataataagataatatttacctcacagtttagttataagcacaaggggtgattcaataaatgtcagtcattatcagtgtcattttctataacaggagtaacaaatagttcatgtaagaaactgaaatgagaactggaacacagtatcaaaaatattcccctatcctgtcaggatgctgtcattgattcaaacattctgtcatttatttcaggttagaacacagtttaagaaaagcattgcttcctcaaaagattatgtcaaagtgaaaataactaattgggagaaatatttcttttccatgtattcaacttgtttgttctaaataatctacttcaaactactgtaaataagttcttgttaaaagtgttttaacttttcaaatggctactaatatacgatgttttacagataaatctttggcattggagggtttccctaattgttctgatatttcttattcccgactcctaccatccacttgctcagaagctcttccaacctctctcaaaaagagaaaataatttgaatgaaaactcatactacaaaagcaacgttaaaatatatttgagaaaaaatgactctcaccctaggtcatgctacaagtgctgtaccattcaatggcacaaaattaacttttagctctaagttcattaccaaagaattctaaagactaaagaaagcatagggaaattaaaaatatttataactataaacaaagataagagattataatgagaaaaaattgtatataaggagatatttataatataattaaaaattaaccgtatacaataaaatttaactcaaaataaacctttccctaagaattataaaatattttaaattcaaacttaattctagtaaactaaataaatccctaccattaattactactttgcattatgaaactttgctcccaaaattttatgctaaaatcttccacataagttctgaagaccaaaaaaatccctactatttcattctaaaacaattggtccataattagtgaaaatctaagtcatttttctcacctttcctttcagcaatgcccatccaatcaatcactagatcctgtcaattctttatttccactattatagcctagaatcctaaataatctaattattttcagcctcttacctctttcatccatatttatgcttcaagaattaccttctattaaaaagaaaggctcaaagaatttccctcacctcctcaaaaaccttagattgtttacagaataaaatgtatctctaagcatagcattcagtctttcacagtgtggcacagaactacaattaacagtaattaaataaatgtaaaaggtattcattaactgcctgataggttccagactccaaacttgatagtgggttggtagtggtgacaaagatgagctcaacacagtacctgttctcaaagaagccagtttagtaaggaagcaggtaagtaaactaaaacttgtactgccatttagttagtacaaaaaaggtaactaactacactgtgctactagaattagacagtaagtcccaactcattgaaaagtaaaatagaaatatgttggttttctgcttctgaaaatgatgaagtaacagaaatagcatacacctcctgccttaaacaactaaaaatctaaacaaaatatataaaatatttgcttgcagacattgcacaacaggcacagcacagcaattgctgagaaaaggaaattaacaaggttattcctgctattgctgtagtatgctgtcttgagagagttatcagaccatgactcagggaggtagaatcctaacagagattgttttatctagggtcacactaatagtgaggagtggagctgggcctctgataggaacctttctgactgcaaagtccccagaagttttaatttttactcacctctacctttttattttttcttttacactatagaaatcatacttcaaaatttaaatactaatgcattcagtgaatctccccgatcccaactgttcccagtcacagtaaagatattaccatcctctaaatactgtattactttgtgtttacggttatataacattaactttcctgctatatttaataataattttaatgtgaattaacatttattgaagccttactacattattttatgttagtaagaacacttaaaatgagatctaccctcttagcaaatcttaatagtacaatatttttaagtgtgcagtattgttgactacaggtacaatgctatacagaagatctctagaacttattcatctgcttaactgaaactttatgtccattaattagtaacttcccattttccctttccttcagcccttggcaaccaccatcattctattccttgattctatgaatttaattattttagatacttcatataagtggaatcatgtagtatctgtctttctatgactggctcatttcaattagcacagtgtcctcaagttttagccatgttgtctcattgcagtatttcctcttttttaaagactgaataatattccactgtgtatatataccattttccttatccattcatccatagaaggacatttaggttgtttccacatcttggtcattgctaatctttttgagatcccgatttcaattcctttagataaacaacaaagtaccaacagaagtaaagtacatcaacatgataagcacatatatgaaaaggctacatatcagttttcaatggaaaaaactgaaagctattcctctaaaatcagcaacacagcaaggatgttcactctcggcacttctattctacatagtactggaagtcttacccagggcaattaggaaagaaaaagaaacaaaagccattcaaattgtaaaggaaaaagtaaaattgtctagttggtagagtctatgcttttatatacagaaaatcctaaagactccattaaaaaactgttagaattaataaatgaattcaatagagttgtaggacacaaaatcaacagacaaaatcagctgcatttctatatattaacaaggaaccatctgaaaaaaaattggaaaaacattcccatctaaaatagcaccaagaagtataaaataggaagacaattaaggagattaaagattatatactgaaaactacaaaacattgatgaaagaaattcaagatggaagatatcctgtgttcatggattggaagactttaatattgttaaaatgtccatacccaaagtgatctatagagtcaattctacatttctgtaattcacatggaaccacaaataccatgaatagccaaatcgatcttgagaaagaaaaacaaagattgaggcatcacattttattgcttcaaaatatattacaaaacaaaaataatcaaaacaatatggttctggcataaagatagatatatagacaaatgaaacaaaatatagagccaagaaataaatctacacataaatggtcaactaattttttacaagggtgtcaagaatacacaatgagaaaaggatagtctcgtcaacaaatggttctgggaaaaacagcaaaataataaaattggacctttatcttacaacatacacaaaaataaactcaacatcgattaaagacttaaatgtaagacctgaaactaaaacttttagaataaaacatacaggaaaagcttcataacattcatcatagtaataatttcatggctgtaacatcaaaagtacaggcaacaaaaataaaaataaacaggtaagactatacatcttgactgcacagcaaacaacatagtgaaaaggcaacctatggaatagaagaaaatatctacaaaccttatatctcagtgattcccaacctttctggcaccaggaactggttttgtggaagacaatttatccaaggacaggaggatggttttgggatgaaactgttccctctcagatcctcaagcattagttagagccttataagaagtccacaatctagatcccttgcatgcacagttcgcaatagggttcacactcccatgagaatctcatgccactgctgatctgactggatgcagagctcaggcggtaatgctcactggccggacactcacctcctgctgggcagtccagttcctaacaggccagggaccattactggtctgcagcctggggcgtggcgagcaggggtgaattccctgatatatctgataaggggttaatatccaaaatacatgaagaactcctataatttaagagcaaaaagaaaaaaaaaactaataatccaacttttaataatgcactaaggaatttgctaaggtctgaatattacccctcccccaaattcatacgttgaaacttaattgcaatgtgatagtattaagaagcagggcttttaggaggtgattaaatcatgaaggcagatcactcatgaatgggactagtaattttaaaaagagatgatgagctgtttgcccttccacaatgtgtgggcacagaggccaccatctatgaagaagaggcccttaccagatacaaaaactgccagtgccttgaccttggactttccagcctccagaactacgagtaataaatttctgttgttcataaattaccctgtatttccttagagcagcccagactaagagacacttgaataaagatttatttaaagtagacatacaaatggccaagagatatatttaaaaatatttaacatcacttatcatcatcagagtaattcaaattacaaccacaatgaggaattgcctcacacctgtcagggctgttattaataaaacaaaagacaagtgttgatgaggatgtagagaaatttgaatccttgtacactgttggtaggaatgcaaaatggtgaagcactatggaagatagtctgaagtttcctcaaaaaattaaaaatagaactgttatacaattcagaattctcacttttaggtatttatcaaaagaaactaaaattagtatcttgaaaagagcttaccacggtatttctctaaatgatgcacttgtaccaaatcatttaatcctcaggacaacccaataggtactacttttagcctcaatttgtagataaggaaactgaaacccaggctaaataacttgcctgaagtgaaataactagtgagtttcagagcaggaattcaaaacagaaaatctggctccaaagtccatgcacataacctcattgcttccctatctgaatcacctaatagacttcttaaatatagagacaattcatataactaatcttgttatttgtatatctcacactatctagaacaacgtgttattgctaatagatattctatgttgtttttgatatgaatgaatgaataaaagagcaatatgaagctatggaggaataatcacactgagtgctaagccagaactctggtaaaccataaactatatataaagtgtgcctaaaattctttatgagaaattattcttcatcctcacaactcctcagaaattttatccacaagtaactaaagttttcacatgtttcactcataggatcttcactcttagctaacttcaatattggaaaattacagacgattattttatgtctattcttaatgaccattatggcacatatttcatacattttagtctaagtatagaacaacattatcagtaagaatatgtgtgtgtgtgtgtgtgtatatatatatatatatatatatatatgaagagtgagagagagagtggggtagatgatatgggggttgaggtagttgggaatgaagaaaccagcaatggtaataacaagataatagaaatgaaaacaactaacattttctcaaacacctatcaagagctcggcaccttattaggtcttttatgttaatcatctcacctggtcctcacaacaaccatgaggtaaaaaaaagttgaaccctgaaattttgatattccttttctttaacaatagattgtatcaagtgaattaaaagaatgtaaagtgaataaccattttattagagttgaagcttaaaagttattggactgctataatacatgaactacatttttttcaattagcgttttcaccaactttataaaaaaagttatataaagggctgacaatcactattattctgtttatactgataccatcatgagttcacatatgtttaatatttattccacataaacttatttacaagttagtacactgttcactaagaaaatatggtaaagttgtcagattcttgaggtagggcacaataacaagtgctagaatcaacacactgtatgaattgccttgaataatcactctagatgttcaagaagtttccacttactctccagggctaatgagtattacatgcaataatcataattaaaacagaagtaatggaaatatgtgcgcatagctacaaaatatcataatctcagaattaatcttcagttcctcaagtctttcttatttatttatttatttatttatttagagacagagtctccctctgtcacccaggctggagtgcagtggtgcaatctcagctcactgcatcctccgcctcctgggttcaagcgattctcctgcctcagcctcctgagtagctggaattgcagttgcctgccaccacacccaggtaatttttgtattattggtagagatggggtttcaccatgttgtccagtccaggctggtctcgaactcctgacctcaagtgatccacccaccttggcctcccaaagtgcagggattacaagtgtgagccactgcgccctgcccctagagtcttaaatcacaaatgtttatcaagaagtttaagttctgttcattaatttaattcactccattcttcgtaaaaaccctgatatgctaaaccttcaataattcaattgcatattatccatactttaaaaataattgctcaagtgacatattgcattacattacattacattattaatggatactagaaatagagtgcctacaatgtgctggggaaaatattaggtgtttacgatatgatcttatttattctccatcattctagtttggctttcttatctgcattttacagatgaggaaaatagctcagtgttacaaactgaatgttcatgcccaaatttatatgttgaaactatacccccaatgtaatgccactagcagatggggcttttgagaggtaactgggattagataaagtcatgaggtttatgggattagtactcttataaaagagacccccaagagctagcttgatctctttctaccagaaacacaatgaagagttagcagtctgcagcccagaagaaggtcttcaccagaactcaaccgtgctggcactctgatcttggacttccagcctccagaactgtgaggttacagcagcccaaattgactaagacactcagaataagctgtccatggtcttacaaagatcaaacattgtactagaaggggaactcaaatccaccttgggctaccacaaacaataagaaaattttgcaaaataggagactataaagttaacatacaaaaatcaacagccttcctacacagaaacaaatgccagctagaaaatatagaagaaaagagcctgtttagtatagtaaggctgtaagaaagtaagcaagtaaataaataagtggatgcaataccaaaaggcagacttaataataaatgtttaaacctaaagccaaaaggaaaattagaacatttcagcaagatacaacagttactgagcaaatggaaataaaaaacagattcttggataaaaagattcaccctcataagaacattaattgttgtgatgttaattcataaattccttataatttcaatagaaatgccatcagggattttctttttcctcaagatctgctagttgattataaagttcacttggaataacaagtatgcaagaaaagccagaaaacactgaaaaagagtaatggtagaagcagggagggaagctaacatttcagatataaaaacaagttataaagcttctataattaaaataatgtgataatatcacatgcatagacaggtcaatggcacagaatagaagaatatagaaatacatctgactgtatagaaaaacttactataggatatcatgcaagtactagaagaaacattgatgaattcccttacaaactggcactgggaaaactgtttctaattatgcttcaatgtgataatatccaagaaagtcaactaaacaactgggtattaaaggcaaatacctctttttatcaaataatcatcattctctggattctatgtaaagcaatatctaaaacaaccctgggaatcacataaatctcaaaattgttgagtagaacaaactttaacagtttctcttccttcatcatcatttttaaaccccagcagaaagatcacagtaatataaccaaaacctaaaagagcctaaaacacacatctgtagggtttggttggaaataaactacactatcctatatccagttcatatctaagacttttccttgcatttcagtacgatgctgcttactttttaagaaggattacaatccttgaatatctcaatccacaatttatatttaaaaatgcataagtaatttctatgtgctagagggcaagggcccttaatagatatttagatttatactataattaaaaaataataataatgcaaatgtatgtcaaagctctgtaaacaatattttcagaaaatttgttgtggagaaggacccctggtgtccagctggatttaagccagtctataatatagctgttgactgcattgccttcaaatctattatcagacagatctttacttaccttgaaatgtttgacttcaccataaaatatatcaagcttctaaaatttgtaaagattatatttatgaataaaaatattggtagtgctacatttccaaataaacattttgagaagcatgatatagattctttagacacggaatacaccatcactgactggcaggaatgtatctcagacacaatagttacagtgtctgattggtgtctctggaacgtatagatagcatctacatttataaaaataaatactatattcacaagtggcttctggaaaagcttcttttaaaaaaacaacattaaaatggcacattggcaaaagacatcacagccttgctgtatactaacactgccttgcaaatgaaaaacctgcactattccttatgatcagggtttcacccatttatttggttaatcattcaaatggctaaacagacctctaatttgaaaataaaaaccaattgatgcaatcacaaacaagttctaaaattgcggtttataaaaattgaaatcttgttctaagccaaaacacacacacagttaccttttcctaatcagagcattcatttctcctcattatgatctcacaagcacattaaaatcttattaacattaattacttctgagcgcctatgcatgagcagtgacagtcgtgagtgtgcgcgtgtctggatcatatctacatttatataccttgctgcactttgcttataaaacatgtgaaaatatttctgctaacaccaattagctaatttcacacacacacagatagtaaactgctgtctcactgcacagcctatcagaaaccagtaaacatatggacaaacggacgggaaagaaagcagaaacacctcttgaatgtgaaaactaaaatgccttatacttgagcctgaatacttaaggtgaaaacaagttgggaggacaaaataacaaaaatagaaaacaatttaaaatgataaaaccaagcatactattttctacacagatggtttcagtgataaaatgatagagacaaagaaaaactggcaagcaaaaagcagcaaacacaggagaaatatacagaaatgaaaatgtccttccttacatgtgtgtacatgcacacacatgcacaaacacacacatatctgctcctcttaaatatactcatattgtaatttgaataaaaacaatataaactttactctgaccataaggtaatagcacactacatttcaaagtcaaacaggtctatcctcacaagcaaataaatattcctgctcaaaccaaatgctttatggattctacttatactaagaacattatatacaggagccattaatacctacaatggaaactcaaggtaaatgcaaaaaccaaggcaattatagccacaaagctacatataactcttatctctttgcttcacaatctccttctctcagcatacaactattttatcattcatacatatactccatcaatttgtattcttctttgcctcatcatatgtccttcattaggaatattattaaagaataaccattgatcatcgcatccacattttctttttcaatccatgtgcccatcttctcctcacagcctagagtttataaatccaaagtcttattagataccactatatctatatagtctttctgccatctttaatttccttgttgccatcaaactatactgtttcacaaagaaaataccaaaaaagtctgtattccataatgaaattttcagtgatgaaaacacttaccctcattggattacaatacctatgtttgtaaacaaaggtgaataataaaacttaaacctaagagtattatactttttatagaaagttattttagaacatttgactacaaaataaatatagaaagaatatattcagccattcagcacaattcatgttaagttgatttaagcagttaagctataattatagctcatgctataattccaattttctacctattgtccagcaggctcattggcctatagcataggggtcaatgacccatagcaatataggtgtgcatgatagagatgggctacataacaaattcctaagtgctctctctgtagagtaggatatatattggagaagaaatggtagggagcagagagagggtttctaaatatttttgaaatagcattaaaatatatgacattggtattaatataaaatgtaaatggtaaccaagaatatactgtattttgttttaatttagtattattcaacatgctcataactgaacaaagtttagtggatattgtctgtgaaaactaaaacttgctaatataagcactattagctaataaagtgttaaaagtttttttaataaaggatagtaaaataatgttagatgcaataaaatggtatttaaagatgagcaagagttatttcaagtaatttccagtttaccataacaatttacaaattaaaattatcatccttacgatgtttacatagactttgtataggtaagtagcaactgtcacagtaatatttactacttgtaaatattctgacttaaccaggcttaccatactgcatgaagagtgccaaaaaaaaaaaaaaaaagactagagaactaagaaaataaaaagttgaaaacctaacagaattagtggttgcctgtctcataacacaatagcactctatgcttaaaaaaaatactgatttttaattagtaaacactgaaatatttgtttataggccatttatagcccactaaacaaaatctgtgaaccaaaaattaaagtattaacaacaattgccaaatgaaggtcaatctgtttttttaatatctaaattaacagatcagtggaaaaatatgagatttgtttttttaaaagattaatttatattaacatcttcaagaatactttgcattaagatagatccctaatgatcagaaaattatggaaaatcaggagtgaacaaagaaataatcttgagtaaatataaaaagtatcatcatgttaatcagttagctatgctgcagaaagcgtcccaagaatccactgacatatgaccaagaccgaactagcaaaaagtgcacaaatatgttgagacttagaacccaccttctctttcataaatgccccatcacaaactgcaaagattaggtggccaaatttcaacatcaaagattcacttggcattctgaaccagatctaagaatcatggtctttattttccagtaaaagctaataagctgagacttacttaacgctttcctgttttgttttgttgttgttgttgttgttgttttgagcttctcaaggaatactgaaattggagactacatgtgaaaacgatagttcatcttttccaaaaaaagatattcatccagattgccctccaatcggtgaaatctgagatgtctaaaaagtcttctttgtgaaagccttacaaatatatccaaagatgttgagtcccatatggctctgataaatgaaacccgttattgtgaatttcaagctcttccttaaatcaaaacactattgggtgaatttggtgctcatgaaataaagcactaattgcgtggcctaacaacactgaatcctctgcctagcagacattttaagttgtgccaaattggttttgggatgtgaacaaatatcctggagccagactctctcacatgcacacactactccctggaagtaagttggacactcttggaaactgcattaactctttcaggccaccagggaacctaactctcactaaaggaaaggcctcttttaagataaaaacaagtcatttcatctaaagttaaacctaagaaagaggtaaaagagcaaaaactaatttgtggctaaacactaaaatgtccatagacataaaatagtccttaaaccccagtggatgctttttcaaatgtatccagaaaatcttatttgggcataatttccaagacattaataagagttgtgtgcattcaggaaaagagaattcattttaagcttaatatgccacatttgcctcaggccgagtgataagaaacttttgtttctttggtaatcactctcaagcttattatatcaggaaatttcttgagtttctatttcaccacatgaaatatgatttccacactagaaatttttttatggtctttttgttctggttcagaaagatgcctacaaacatgaagctgagtatttaaatggcaattaatgtaatcccatctcccttgcactcaaatttaggagttcataaaaacaatttttaaaagcacctaaatataagaaaaatgtacaaaaacgggcgttgtatttctttctctattttttagtcttaatttcttcagcagtaatttcttagaaataagttgtttactttggtagggcattttaattaagcattttatttgcagtatgatgaaagcacagcatttctttccccttttatctcactaataaataccctggattatatttgtccccgggattacctaaactaactacaattttatgcttttaggtcactgtcattttgttgctgtcattcatctttcaccttaaaggcttatgaagatatagataaagtaaaaactacttttttggaggtggaaatagctaaatgcttgtgaaaatggtatttttcagtcatttctagtttaagccttctatatttcttagagaaccgtatttattttgtgtcaattggtgtgaatttaagagtattactagaaccctatgttccacctccaacaaagctttatattctaacaattagcctgcatgtgctgctgctattgactcttaataatatataaaaaaaacaacagccttgtcagccaaccctacaaggaaactagctgctatttgcaagtagacaggacacagttgtaaatcaaatgtgtgtagctgcttcgggcttctattggttcaaactgcaattcttagaatggaatacaggctatgggtgtgtttatatgaaggtcctctacctgattttctctggggttttggatctctgaataattcatatatttccaaatcaaaatttagaggatctgtagtgcactagtctgtgtttgtactatgtctgatgtgatggcatcacttctaagttctgttgcatattcagttagtcagctctggtaaccgagtaaaactcacactctagtagaaattgtttggtatctagaaccttactaaggacactaaggggtaaatggtaatattcaacagataccacattaaaaagttttcactaatttttaagtcaaatatttatcatatcagtgagaagttgatccaaaacatattcacaacttagggtgatactagggccaaatagcaactttcccctggggttcaagcacagaggctaactgggacagttataaactttatggaagtctaaaattctgattcgtatttctaccatggtcctcctttccaacttaaatccatctaatgatatcaatttaggaggaaaaggtatcaaaatttagcttatgttcatttcaaatacctcagattaactgtaattaggaggtaaaaataaaaatggcctgtctttaaataggtgtccattacatttttcacgtttagaactctgccatgagctcagaactatttattcaatgacatttcctttttccagttatatcttcattacttacatgatccaaataaaatagagaaaaaaaggcttcacgtggtggacactgtccttacagctcagctaattctaatggttttaaaagtctaaatatatttaataactagcctctacacctgagattatcagcagaatacttttttagatgttaaaagacagtagccaaagaaaagaaggaaagaaaacgtgagtagggatattaggagagcatctttatcagcaaaaaagctggattgtccaatttcctcactggagcaatgaataacctagttcccagtaccaaccccaacactgaaaactgctgtgtaactgtaggcaagttatttaacttcaactggctcctacttcttaatctgtgatgcaagggtaatatagtttcaggcaccaactgcttcctgcatccctatactggctaggatcttttaaaaattatttcctggacaaaacctcacccacatgccatcagttattttccctcctttttcctgcctcctttgcctctgcagggaaataaaattagcagtcaaagttaaacatgcccagtgggcaagacagactttggtttaaggaaagggatggagtaagttgtgttaaagtgcttatttggccccaaatggttcattgttgggataccacctcccacaactagctccactggaatttttctcaggaaaatggagaactgttttaagatagacatgccctgtaagctggtctcaaatcaaaataaatttaggatattcaaaaaatgccctacaggatttttcctgtggagcctaaataaatcactgaccaaattttccaattcatgctctgctgctaaaggggacgttctacaaaatcatgttttaatttctacatctgaaaaaggagtataggtaaagttcttcactttgggttttcattcttctctcttctctgacagtattctaaaagaatgccatttgagaaaagaccactcttagagaagaaaattgaaatataaccccaaatttccaataaacttgtaagtctgctaaagacaagaccataaccctggttagagattttgtgggtcttcctttaaaaaaaatgaaccttttaatacatagagaggtgttaagaatatcccaaaagtgtacacatatctaaatttacaaaatcatgattattttcacaactaaaggatatattttagagctcttttaaattgtgactgcccttactgcattttactgcatatcaataatttgcatattattaaatatttaaaaaatataaaaattacatttttagctatccatacaggataagtgagaaattgtacaagtttgcatacatgtgctgtcattttatactatgaggcattgtttttttcagacaagaacatcaggaatgctcaagagtcagtttttagatgttatgaagcactgaggcattgatgctgttaacactttcattgaaatttaaatgcaaaccaaatattttaagaccaataacaatggatatgccatgaaattgttgtgtttcacagcgtgtcataataggtaaaattggaattttccttcaaataatctgtcccatccaagagttttaactctcaaatataaatataaacaaaagattattcacttcaactgatttccctagaggattatgcattatcaattccaaactttacaagatttaagaaattactggactgattaagtgtggcaaactggtttgttccctacaaaggaaacaaacttaaatcccacaaagtttaattagcatttagtggctcaacaaatggaggaacagcctgattctgaataactgcaaagcagagtcagaaattgtatatactactggttaactttgctgtgaaaattagagtgaaccagaattcaatcccagttctgccacttactagatctgcaatcttcggtaaaccacttaaccattctaaatctttctttcctcatctttaaatagggttaagaaatacttcatagcaaaggcatggtggttaagagatcccataggcgaagttccttaacaattcattaactataattatcactacaatttagaccccttctgaccattgagaacccatgaattctacatccagctaaaaaccattttgcaatagaaaaattttttcaaaactcaatttacatggtctaagcaacaattatgatagcatgtcaggggctaatgtggtgccaaaagttagacattatcatttaacacaatgggaacctggtaaagatttactgaatgaggaaaaaatataataggatgtaatagaaagaacagagactaaatcttggctttgactcttagcagctgtgtgaatttggcaattttttctgtaagcttcagttttttcatctaaaacataggcagaaaaccagtgtatgcaacaaagttgttgtatgcaaagattaaattaaacagtttgtgtgaaaggtgcttagcaatatctcgcttccttaattttagcattataggacaagagttctaatcggttttcaagcctaaacttttcttatatagcagtatcaactctggcctcctacataaagtaagattatgtttagttaaggaataatgtgagagatgaggataaattcaggtgtgacagtaaatatattttaacaatataccctagaaacaagagtaatgattctcaaaccttgcaatattactaggatctttggtgtagtttttgcaaaatatggaagcccaaataccagtctagagactccaattttagatatgtgggagtagaacctaggaatctgtgtattttaaaagcccttggctgattccgacatataataatcaactaaagtcgagttttctgaagtatgtgggccagctacaactcaggatgcctgagttccattccatacccattaataatggagctcagaaatttgaattttaacaaaaatccgaagaatatcttatgtaaactaaagtttgagaaccactggactagaatatagtaagataatattgaaaagaatttttttcatatttggttatttaaacttttttccctctatttttaaataaacattactgtcaaaatttatgaatgatgggtaaaaattttatctaaagaaaatattagttttagggtaagtattatcattattattacaggtttcaaaatcaaaatgggaaatagagataacattttaagtcatctacagagggtccaccagcacagaaaagtatatcacctaggaaacaccatgcgtttcactgtttcttaaatttgtgtgttttgctttgacttagttttttattatccattccttctttaattagagcagtaatgccaataaataatatttgtatactactttactatttataaaaaaacttcatatatattaacttaattaatccttacaataaccttgtgaggtagataggaaaggtaatatatattatcacatttctgccaataagaaaactcttaaaaagtttgtgcaatttgcccagtcataagtttgctggtatttatggtaatacgtggactgaaacctctagatgtaaatttcatgcaaaactgtgtgaaatttaaaacttaggattcatttttaagtgctatgaatcaaactcaaaatagcatgagagtctctgaactgcaagtagtccatagtcctctaccaacctgtgggttcatcttactatataagttcattgtactttatttattatatggttaaagaatagaaggagagtggagctcaattaaccaaaaacaaatgaacaaaaaagtgaaaaacaaataaaaaaatggaatattcatccattataatactatttactctgcctacttgcaattcattcccctataagcccctttgcctcagtttcctcttctaaaacatgaaatatcaaatagcactttcaaaggctagcaatttcattttcaactatgatggtactttaaaaagtacaactaaatatacagctagaataatactaacatttgcccaatccctacaaaaatcctgtcaaatcaactagtccagtccactcattttatacataggaagtagacctaaaaaaacttaagtatgttaccccaaataatagcaaatttgttgtaaagctagaattaaaaattatctttacatcaaagtcaattacaatacacacttgtgaataggcaatgccttgttttcataatcaaaaagagaaaatggtcattttaagataaaaggaagaaggtaatttataaagggatgtttaggcaggaagtggtatcagaagctgtttttccaaagtaaaaaggctccaaacttatttacaacaaagaaatgtgtattttatatatatatatataacacacacatatatataatacatacatatatatatatatatacacgagaatgttataaaccagctagacataatcatttgtttagacctcaaatatttgcatagctctgtgctgaatgccaatagaaggttctggaggatgaataagacacagacactatcctcaagaagctcaaggtttagttggaagatgtgcttacaaacaatggcaatacaatgtgagaggtgatattgccaagttatgcatataaaattgctgtgggaatgtgaaagaaggagcacctcaatgcctgaaatgaccgagcttaagtgagtatctctgacaatccctgtcttctccatttccaattctaaattaaatacttccctgtttatgcctagaattgttaaagaattttttatataccctgataggagaaaagtagtaaagtgcacacatcctaactttttcttgggtaataagaaatttcaaagactaaaacatattatagaattttggtacagctactacgaaatcagggcctgaaacaatttgccaattttttgcaaatgtcctgtttttttgttgttgtttgtttttttcactaactcatgcatcagttacttgcacagcaacagggacacaaggtggcactgtcgtgctgacattcatttcagggtcctttctaaatggacaaatttgtaagagacagaatagaccctattgtgacaactaacaccacagttgtaatactggccgactgggtctaccaacattaacactggcctaaagaggagtattttgcatttcatgaatattatatcatgcctatatagaaataggacatattctctgatgacttctccaaaatgtcatgtgtgtattcatagaaatgtccaaaggcatagagtgcagctttgccattaggaagtcagaagtgaactgcttgctattggcaaggcagtggacacggatcgcctctccatctagtggccagtggagaggagtggagccatagtaaccatgctgcacttcattccattaaaaacagcccttttaccaaatcacccataggcaattaagtcagtttgtctgacaaatgactatttttggtttatggcattcgttcaatcattaaacagactcaataatacattatgatatgtagttaagctaagaaaaatcatcacaaaattaaagtgcctgtgctctctcaagccacataaatgtccgttattcttcctttattacccaccctaacttttctccatttatttgtgacttttagatagaaaatgcaagcaagattatctacatatatagctacttaaaatcacagtctttaagatgaaaaaatattttaaaaagctttctcctcattttacaggaaggaaactgagggacagagagatcatgatgtactcaaagtcacaaagtcagaacaaaaaaccagacctccagatttaaccactttaaatcctttttgatattgattaatacctcctgattccccaggaaatgctttttgtatcacaccataaagtttctttcaacataccagaaaaataatttctaaaaatgttttttattcatatattttcagactaaggtgatataagtgaaactactgtgtataggccgtaccacatcttcatatccataggtatattttgaatgtgttataagaacacaattatttttatattaaggaattacattcatccaacatttagaaagcgaaaaagcaagtggggtagggaataggtggatgtgttggtcaaaattactatacaaaaaatggtttcagaaagccattatgtgaaacaacctgaattcattcagactgctagaaaagttctttttgttttgtttcatacaaattatttgactttgtttttaaaaaggaaacacacgcacacttatccagctaatcacttcatctattttaattcagcatgtgatgctgtttgggggcatgttttgggaatgtgttgttggtaaagcttcttatcaaaacaaatgaaatctgtccaccaactataaaaatctgctcacaactccgaacccaagaattaaagggcaaaaggtatgaaggaaacctggcagtggatgttctagaaatgtgagatgttttgactttttcttctatgatcttctttggtggtaccactggaatctgtcttggagtgcagagggaatttatatagatctgctttagagagatgcaaaaactaatgctgtacagataagtcaaatgctttttaacgggagttagggaagaagtctttttatttcattatacttctaagtttagaagcttcaaaagcaccaacccctcagctaccctcagctttacccctgtaccctcagctttatcccttcacattatctcaacttctctctacttgtttcttaatcatctctagtcgtctcccttctagaaatgaggtgaggggataaagatcactgttgatttggagaactagagaaagtaagggctaatataaaaagtaagttatttttgccttacctaaagctaaggtaataggtacaagtaaccaagaagtggagaaattagtaaatatggtcagaaccagagtatatttattgggccaagaagaattttaatgtgtccagtatttaagaagaaaaaaaaacaaaaaatttataaagtcaccattacaaagtatttgcctagtctatttaaataataaaagagaggaacattttctcactgtttaaatgtcttggtgcctaaataagatatttttgtttatttaaaatgaagccacatagttttcacatacacatatatatcaactagaaaaattacatagcctggaacatttctagttttctgctagtaatagcttttttttttttttaactaagttttaagttgctacctgaacaaactgacaacattaattttctctcaattacattccatttacaggaaagaagttcatactataaaaggaattgcaacaacaaatcacaatttaattacaacagtaattcacagaaaatttttgaaaaggtaaaaatggcaaatatctaagctaattcagtaaaaaacaaaaatgtaaagccttctaaaaattagagaaaattaaaatttaaataattttaaatgtttcattttaaaaagtttaaattaagaattttcccaataacaaaaatagtactactatgtataagattcgtaattattaccatttctacatttttagttacaaccaattgggcatctatctttttgatatcccataaccccaacctcataccataattttatatttgttgaatgtaaatccttacattagtaatgtaatataaaaactttcaaatagattgaccttttaaatgcataatatgaacattaaattcatcatatctcaagacacagaagtattcagtgacaaaattacttccaatatcaagaaggtaaacatattatgctgtaattaccacattttctatcagagtttcaaaggtaagactgaatattcagaattaataaaaaatatgttcttcttccctctggaaactagatgaatcaatgaactcatagtccttgttccttgtctcagtattctcacttgaaagtcagtagccagctttccccaagttaagacaattacaaaggttgcattggttaactgaactacaaaacaccaaggctagagtttcagctgagtgtcaaaagattccagaaaggcaagctccatgtcctcaagctgattactttcaaatgaactatagaattaccaaaaggcttgatcctggagtataagagaggttatgaagccaaagtcaagcataatttttccacagtttagtacagaaatagcatgccacttattcattattacagttgaacagctagagtggcaaaaacaaaaaacaaaacaaaaaaaagccctttttcttataagcccttgaatgctgtttctaacaccggctgtagtggttactacatacatgatagtaatcatagatagcatatttcttcccatagcctcatcagcttgcctatgctgaattagaactaggggagctcaaggatattttgatatattaaacataattgtcatcaacattatttgatgattaatgtataatatctatgtaataggaaaacatgaattcaggtattctctagaatatctaagatatgtatattgccttcaggcttttggtaaagaataaaattgatcttgctagtttatttgacattagctatagttcctggagattatgcaaaatgctagaatttatttaagcaatggaaatgtatgaaatgggtttttcaagaaaattacaagtttcaagttttgtaaaatacctacacacctatacatgacttgaaagcttggtgtaaagtatcaaatgtaaatgctgactgtattagcactgtaaataatccatagtaattgtataaaataacaaaaatgtcttacacagtatgaaacaaattattttaaagatttggtttctaatttaatgataactctggcaggtacacacctgtccgattgctagtgtttattgtccttgatggagggtaaactgtttctatgtaggtaatacctgatttctataatgtccctgaaatagttacacagccatgcaaatgaaaatatttagaggttcttttcagtgctttgtgacttctcatggtaacttagatcttcactggttaagaaagtgagggataaggatactattttacttatgttttacagtaaaacatgtctcccaccaaaaatgtagtttgttaaaatatatttataaagtgacctccaagataaaccagctttaatgtccattttcaacatttagacttcagaggccacccttgaggctgaagaacccaggagctagcagcattcaaagaatatcaacaccagtcattcttttgccagaaaagatcactagttagcaatattagccaggtgctgctgcttcaacataccttgccagatgttggggtaacacgtttgctcagggcctgaatttggcttcctatgtggcggcatgaccggccactgcttagagttgggcaagtccatgaacacatccactgataatttctatatttatagaaagccagaacatgtgtagataatcacacaattagatatttatgtagtgccagattttatgaatacgagaatttgttaattagcacaaggactaatcattaaaattcaaaaatagataaataaacaggaatgccatttatttgttaacatttcatggggaaagtatgcagctgctatccttttgatgaatataggcttctggagataaaaatgtgcagaataaaaagtatctgcaatttttgaaaccctaatgagtaaaatccaataaatcactatatagtctttatattaaaaataatcatagtgattctcctcttaagttaaaaaagaagaaaaagtttaaactggcatatgcttagcatttgaattatatggtctggcattccattttatttgattttatttatttatttgttttgagacgtagtctcgctctgtcaccaggctgcagtgcagtggcacgatctcggctcactacaacctccacctcccgggttcaagggattctcctgcctcagcctcccgagtagctgggactacaggcatgcaccaccacgcccaggtagtttttgtattttttttttagtagagatggggtttcaccatgttggccaggatagtctcgatctcccgacctcgtgatctgcccgcctcggcctcccaaagtgccctattttttttaaaaaaaatctactgtttggtccttttcaaagagccaaagctgatttttatcagcacacacacgttaaaaagcacacacacgtcactcagtaccaaattgttttagctacagggcatggcaaagcatgaagtaacttcttagagcacttcctcatgtgggtgtgttaggtaactgtctgctccaacattaaaatgaaacacactgtgacctgaccaagactttggggatctaaacaggcagatatcatgtgctgataggaagagcccactataaccaataaggctgattaatgaatttttctggcattctatagcgctcctgtaacgcaagcctttcagctttccaaatccctatacagcagagtacagtggtttgaagtttatttatgcacattttataatgtccttctgtatttagattgtgacagtccctcccagaaaaggccaagattatttttcatactaaaaatattttagatctactgaaggttaagaattataatgcaaaagaaaacatatacacattctaaaaattaaaccaaacataaaaatggctacattattacttgcttttattcttgctaaaaggttaaaggaaattttcatttttctcttgaaattctctccattttttgtttgcttgtggttaacataaacacacataaagtgaaatttttaaaaatattgtatctgaaaagaagctgtgatgtatttatccatacatgtatgacttcgtgtcatacatgcacatgtatgcacagatatcgccactgtatgtgtgtacagaaaaagagaatgactaatcaagacatagatgaaagatttctattgataaaaacagtagaattttagatggtcctcacaaggctaacacagaaaatgacaggtgcatgagacatgtacacttttgacatacagtatcagttttgaaacaaatttttgggtcaccgtcagaaatggcataaagtatatataaaattgtatatgaaaaacaaaattatcgtgtaccatattaacataaaatactctcctaaagttccccttagaccttacggaaaaaaatctccgacgggacctgattgagcgtacttagtatttgtactactcttggtcaaagccagcctatccagtttaaaaaaactgttcaggcaagataagcaaattgaaagtctcagaattaattttttaaaagaagaggtaaaaaagtctttcagcagcaaaagttcatcaccttcctgaaataatggatttttaataaacattttactaggtttgaaccttgagaatgtgtttgggaatctgctctagtgtcccaggtgggttaagaatattgctttatggacttctttgtgttgtcagagaagcctaatggaattaagggggaaaaaagtctgccacttctgttaaataaataatttattacaaaaagatgactgttattatcaaagatctctacagatcagcatccattttctaacattgctctgtatatgccgaaacatttgtgtatctatgtgacttaaattttatcaaatgaagagcagttttactttgacaaatctgaaataaaattccattaagaagtccatttcaaatggcccttattaaaataatcctttcaattttgaagaacactattctgggaaaactcttcaacaatgtctgctagtttgaaatgtaacttttcccactataaaaaagaaaaaaagaaataaaggaaaagaaagcaccacaaaactgaatttgaaataaaaattatattatttatgctccccaaaatgttaaatgaatacttacagttgttgtgcaagatggcctgatacacttcatagcttccactttgtaaaaagatggccagcccctcactccaccctccccaagcataaataaacagtaacatactaaaaggaaactgtcctaggataaaaactgcttgttaagaaagttcgcattcttactaaccaaagtgatattcctataaatgtaaaagcccatctgcaaaataaaagttagaaaacagaataccttatttgtttaaaaatacatcccccagatgcaatgtttctatgtgtgtgatgacaaaaataattactccattcttacccaccctcagcaactacccctcaccttatgtccaatggcattaaataaacatgctggcaaaaagtattcaacctgcttcaaggatttaaactgtaaatatggactttaaacttcaacataaaacaaagaacaagagtctcactttagtaatacccacactggcactgcagctaaaactcattggcaaataactaacaaaaccgagttagcaataaataaggacaacatgatatatagacagacagatggaattgcataaacagacaagaaaagcaaagagacaaacatacggaagggtctgttttaaaagagtgaaagattctgatttatttggtactttagtgagaaaaatagatttgtttgtaattatttttaaagtaacaaaactgaatcacaagggcacacccctaagtaagtaggaagaaaattagtaaagggtaggcctcctacagatgttctaaattttaagctagcactagctctgtcaaacttaaatctggaaattaaaattcaagcaggaaagaataaaggcattgggggctaaaggagatgacagagggggcattgaggaagcaggatttttttttttttaagaaagttgtctgccctaccttcttccccagcgctgagtttctcttcttataatcggtgtctccctggaagtacagtgtgagtggtaatgactgcctgcctccctaatgagtccattttcctgctcttgatgttgtgtatatacacacactgcaacctaccttacaaaccacagagacgggaagagagagagagagcaagagagaggagggaggggggaagagagggagagagagacagagacagagcaagcgagtaagagagagagaagaggagagagagagagagagaaagaaaaacagaaagaaacagagagaaaggcacagacaaagccctcctaccagacagcagacagctctccttcccctatccagcaaaatgcaactcgtctaatgcagcaacaggttcagtattgccagactaacagagtgaaaaaggtatattctctatatcattattgcttgcaaataaacagtttaagagcagctggctccaccttctttatttatgctccattatgaggaatgtattgtttcagttctggcagtacatgtaattatcataaatacattttttgcatataagcaggaaatagtgaaatgcatagcttatttgtgcaatcttttaaatttatttttaatgtgagaagaatgtgaacaaatcagctctgacaaaagcctagtaatgattttaaagtcagagcagtcttaaaggaggctctgtaagaaacagactccatacaataggaaaactgatctcagacaaaactgataactgcaaagaagaaatcattgctcagttaataaatcgagaccatatacaaaattgcagacttacaaaattacagaccaaaacagaattaagcttaattaagtaactaataggctaggaacctagaagaagggagattggcttctcatttaaagcatctagctgtacaaacatcacaatgcaatgtactctgtgtgaacaggtgcaatgcgtatagtacatagtggtacaacaacagaaataaatcccataagaagctaccatcacaatcaggatgatatttcatagaatatgggactgaaactacagcagttacccttaatcttttattaggagggaaaaataaaaataatcaatgcttctaaataaacttgccttaaaagagaaaaaaaacagtttttctttgtctgatacttctaaccagattttttctatattctagttccaaaattatgatgttattatactcctcaccccatcacatgcttcccacccactttccccactcctaggtgccctttctcctgtaagtgatatatttgcagctatagaattacaaacatcagaaaacagaaatagttttaagccactctcctcgtccccgaatttttaaaaactagactctgcttgacgagtcatatctccttctagcactattatctatctagacacccaccttccttaatatatttctatacagtttggctatgtgtcatttagatgggacttaagaacattataatagaggtaaaattttctaaaaaatatttacacacaaataaaaaatataagtgcatttgacttattcaaaccctgcgtttgggcaacaataatcctaagtatatgaattgtaaaaatcatcctttttatgtggttttgtgtattaacatgcttcaaaaattagaatatgtccctctgcataaacaaaactaccttgaaacaacagcttcaattcttttgtttaaaaaaaatcagttttcaattaaaaattaaataactttcaatatataacttatagatcaaccgattcttcaccttattcacaaaaatctttaagaatgtcaaataaattttgggtcatgtttagaatacagatcaatattgctttagctattttcagggtggctaacctacagcacagacattagaatgtaatatctacctatacattatacaagctatcctgggaaaatttctagtaagaaaccaagagtccagaccactctagtctcatcgtaatccaccaattcaacctctctagtgctgcagtagtatatcaccctcccaagggtggatgattaaaaggagacagacacacactaaaaatgatttaacagtctcctacttcaggtcacttgtctgtagagaaacttttccaaaatatatttagtgtgcccaaggtaccagcatgtatctcctcctcactatttggcctggcagctctgcttttctactattgccctattgtttctccgaagctttattaaaatgtattaagaaaaatgtcaattaaaaaaacacataaaacttagagtttgacagatggatttgaattagatatttgtattttctgaatttttaaaataaggttctaggtattttattttgtttcattttgtttttattcaaggagaagacgtatttggtttctaccagcaggaatcaaaaggaatataaaggaccatgaaggctcttttctaaaaaacaacctgagagctaaatttaaaaggaaaacaaatcttttggcttaagtgaaaaatgagaccgggcacagtggctcacaccgtaatcccagcactttgggaggccgaggcaggcagatcacaaggtcaggagttcgagaccagactggccaacatagggaaaccccctctactaaaaatacaaaaattagctgggggtggtggtgcatgcctctagtcccagctgctcaggaggctgaggcaggagaatcgcttgaacccaggaggtggaggctgcagtgaaccaagatcacaccactgcactctagccttggcaacagagcaagactccatctcaaattaaaaaaaaaaaaggtgaagaagaagaagaagaatgtacaacatctcaaaacttttcccatatctgtacattttactagattcaaagcacaataagtagtacattgttagtacttactggaattcaagatatactttccctagttgggactggagacaataaggtctgaagaaatcattgtaattgactaccatactatggaagttataaagttatttaattaaattgcttcatgtgttgatatgtcatggggcaatttggttctgtagaaagatcctaaagtggaagttaaaaactggttctgtcccaaattgatctatagattcaattcaatcccaatcaaaatcccagaaagttattttgtggatatgaactaaatgattctaaaatttatatggagaggcaaaagactgaaaataaccaacataatattgaaagagaagaacaaagttggacaaatgaaactaccagacttcaggacttactataaagctacagtaatcaagaatgcatgatgctggcaaagaatagacacagcagatcagtgcaacaaaatagacagcccaggagaaggcccacatatgtatagtcaactgatctttgacttaaaaggaaaagcaatacaatggagcaaagacagtatttccaacaagtggtgacggaacgactggacgtctacatgcaaaaaaataaatccagacgcagactttacactcttcacataaattaactcaaaatggatggatcataaacctaaatgtaaaatgcaaaattctaagactcctaaataggaaaaaatctggataattctgggtttcacaatgactattttagatacaacaccaaagacataatccatgaaagaaataattgataagctggatttaattcaaattaaaaagttctactctgcaaaagacactgtaaaggtaatgaaaagacaagccacagactggaagaaaatatttgcaaaagatgcatctcataaaggactgttatctaaaacatgcaaagaattcttaaaactcaacagtaagaaaatattataacctgattaaaaatgggcagaagactttaacagtgacctcaccaaagaagatatacagatggcaaataagcgtatgaaaggggctccatattatatgtcattggggaaatgcacattaaaaataacaatgacataccaccacacatgtaatagaatggcccaaactcacagcactgacaacaccaaatgatgatgcggatgtggagcaacaggaactctcattcattgttggtaggaatgaaaaatggtacagccactttggaagacagtttggcagtttcttacaaaactaaacacatatacaatccagcaattgcagtggttggtatttatgcaaaggaattgaaaacttatgcccacacaaaaacctacacacagatgtttacagtaattttattcataattgccaatatttggaagaaattaatatgcccattagtagatgaatggataaattatggtacatccaggcagtgaaatattatttagtgctaaaacgaaatgagatatcaagccatgaaaagacatgtaggaaacttaaatgcatattactaagcaaaagaagccaatctgaaaagattgccttctatccactgtacgtatctatacactgtatgattccaactatatgacattctgaaaaggcaaaaccatggagacagcaaaaactcattgtttgcaagagtttagggtagagagagggatgaacaggaagaacacaggattttcaaggcagtgaaactactttgtataatacaatagtgacagatagatgtcatacatttgttcagacccacagaaggcacaacaccaagagtgaaccttaatgtaaactatgggcctggagtaataataatatgtcaaagttggcttatcatatgtaacaaatatatgactctggtgggggatattgatgatggggaggctgtgcatgtgtgaaggcagggggtatatgagaaatctctgtacctccccatcgattttactatgaaactaaaattactcaaaaaaaagtctattaaacaataaattaaaagaaaattggttctggtcccagcattgccacaaatagcttgcgtaccctcgtcaagtcatgcaaccatcctgagtttcagtttcttcctatgctaaaaataacaaatttaaaaggacggaattgaacagcgtatcataataatagttattaaagccaatgcttaagtgcttactatgtgtcaagaactgttctaagtactttttatttcttaactctttaaagcctaacaattaccctataatgtaggaattatttttagtctcattttccagatgaagaaaaaagagagattaagtgacttgcctgagatcacatagcataataataatgataggatttgaacccagcctgtctagcttagagtttatgtgtttaatccctacactatactgttttacccaatacctaaagatagttaaggccccatccagccatgactctgtggttgtgagtcaaatctagtaagtcctgatgatttcttaccctatcttgcttactaacacagaatagtgaaaatttgctgtttaatacccatagctctcaatacgttcaatttaatggtacccagcaactccatctaaagtacatactctatcatgcattcttaaaggttgcatagttcaagattcaaatatctaatagtaatgcaaataattgtttaaagaactaaataataaacacaataaaatatttcctattttctatagcctgagaaaggaattaaaaaagcaagaattcaattgtaaaggatttgtgtattttgggggttttgtttgtttgtttgttttttgagacagctccgtcgcccaggctggagtgcagtggtgcaatctcggctcactgcaatcttcgcctccccagttcaagcgattctcctgcctcagcctcctgactagctgggattacaggcgcgtgccaccatgcctgtctaatttttgtatttttagtagagacaggatttcaccatgttggtcaggctggtctcaaattcccgaccttgtgatccgcccacctcagcctcccaaagtgctgggattacaggcgtgagccaccgtgcccagacaagaaaagtctgggattagtgggtcaaaatgagtaattgctacgctaagtaaatgactttgccattgaggacaccaccataaagttaattgtaagtggcgtaattacacaataattctttttttttttttttttttgagacagagtctcactctgtcgcccaggctgtagtgcagtggcccgatcttagctcactgcaagctctgcctcccgggttcacaccactctcctgcctcagcctcccgagtagctgggactacaggtgcccgccaccacgcccagctaattttttgtatttttagcagaaacggggtttcaccatgttagccaggatggtctcgatctcctgaccttgtgttccgcctgcctcagcctcccaaagtaatggaattacaagcatgagccactgtgcccggccaattaggcaataattcttaaccctagtcatctattttaaaattgtatcccatcgggcccaaggacaatagtaggccaggagtaccatccttaaatgggaagagttgcacatctaatttaaattctaatcaacaaatgtttaaatttaaaactaaaataaagtattacatgtaaactaagtcattggaagtacatttattatggccagaggattttatatgcctctctccctacaagactaagagactccctccccaccatcgccaccttcttcccctctgccccccagagcagagaccctacttattaagctttgttggtctagcatctggcagtacacctgtaatatatctgaagctcaaaaaagttttcctgaaagaatgaatgactaaacaaacaacagtacatagggtttataaaccttggttaattaaaaacttaaataaatttgagatataaggatgatataaacaagtaaatagcatttcaaaaaatgtattgtcacatattaaacacatccttatcttaagatcttgtgacaaacaaaaatagaaaaagtaatcttcaactttgctgtatgtttgaaagaatttcacaataaaaagttggataaggctgcatgcagtggctcatgcctgtaatctcagcactttgggaggccaaggtaggagggtcacttgaatctaggagttagagaccagcctggacaatatactgagaccgcatgtctataaaaaaatcagccttgtatgatggcatgcacctgtagtcctagctacttgggaggctgaggtgagaggatttcttgagcccaggaggtcaaagcagcagtgagctatggttgcaccactgcactgcaacctgggtgacagagtgagactgtgtcaaaaaaaaaaaaaaaagtttgttaaaaaaagtattcatatctcacaccagtcagaatggggattattaaaaagtcaagaaacaacagatgctggcgaggctgcaaagaaatatgaacgcttttacaccattggtgggaatgttcaaccattgtggaagacagtgtggcgattcctcaaggatctagaaccagaaatgccatctgaccccacaatcccattactgggtatatacccaaaggaatataaatcattctactataaagatacatgcacaggtatgtttactgtagcactatttacaatagcagacatggaaccaaccaaaatgcccatcaataatagactgggtaaagaaaatgttgtacatatacaccatggaatactatgcagccataaaaaggaatgagatcatgtcctttgcatggacatagatgaatctggaagacataatcctcagcaaactaacacaggaatagaaaacactgcatgttctcactcatatgtgggagctgaacaatgagaacacatggacacagggagaggaacgacacacaccagggcctgtcggcgggtggggggtgagaggagggagagcatcaggacaaatagctaatgcatgtggggcttaaaacctagatgacgggttgatagatgcagcaaaccatgatggcacacgtatacctatgtaacaaatgtagaggttctgtgcatgtatcctggaacttaaaaaaaaaaaaagatattcccatacaactatcagaatttcaataaacatcatttctgaaaagaaaattcagcttgccttcacatttcatttatctattatttctttcaaatctataacataagtgtttgtaaaaggctgaagttggcttcagagtacttcatgggaatggaattgtcctctttgaggaaaacatcttgataagctgctggagtcagagagtgaggcatgaatatttcttgtggggttaaactgtactacataaaaaatgagtaacaatttgaagttaggggagcacagagatgagagggaggaagaagaggagtagtgggaatttcccaatgtaaacgtggccagattttttaaagtaatgcctaataataaattctatgaagtttatgttttgtgatgcaaatattctccttctctccaaactttcaggaaaggataatgtatattctacagtcttatatagtagtagaacgaagaatcaaataatgaaaaaatgaagttattgcctcacattcacccatatactgtagcctttataatcacggcagtttcctaataagacagaaaatattaccggagttcctcggagtgaccagtggtagagtgaacagtggccagtgaatagtaaatagcaaagagtagaaaatcaaaagtatctttaatatagaatgactcatatctatatatgagtcattttccacaattgtaaaggagaaatatgaccatggggaaaagtggcacggagtttagtatctgaatgataagattattatgctattatagctgttgttactactcctataagctgatcttaaatgatatgattatctttagaaatttagaagagggtacttttgtgacacaatcaataaatgctaaatcaatggattacaaaatataaaaatgttatttgtaatatctccctggctccagaacaacgtattagacacatatactatatgaactcttctgctgcctggtcaatcctctctactaaacaatctacaacaatgccagcaactatcttaaaagtttccacatctacataatttacttatatgtacagtttatatttaatacaaaaggaaaggaaagagaaactacagagtgcattctataggaaaaataaaagtcacagagaagatataaaaggtacatcttaattgccatagatgtttgtcaagcaggttggtgagatccttactgtttgacctggtgcggctatactcaaaaactcaatagtcttcatatctttccaaaatacaaaagttgctactattaataagaatgctttattaaaagttatctctactacatgtgtcagaaacagcccaacatacactttctcatttaatcccccaacagcattaaaagaaatctcattttcagattatacataaacaaaaagaggcccaaagacacagacctaataagtagtaaacgtcgggcctaacatctatccaaatagaatgtgtaaggaatagaaggaggggctttataaaattactccaaaaattatctagaataacagactggtgatattaggtagaaaaagaagactaatgatggggaacagatttgaaaggatatatgttccctagataatttcagaacttaaaattttatatttgtttgaggaaaagtatattaagtatctcaaagtaaaatttaaagaaaggataatggaaaagactagtatattaaaaaatagctttcaaaagcgatgaaagaaacataccatgaaccagtttgattaaagagttggaaacattaggcggggcactgtggctcacgcctgtaatcccagcactttgggaggccgaggtgggcagatcacctgaggtcaagagttcgcaaccagcctggccaacatggcgaaactccgtctctactaaaaatacaaaaaaattagctgggcatagtggcacatacctgtaatcccagctactcgggaggctgaggcaagagaatcacttgaacccgggaggcggaggttgcagtgagcagagatcacgccactgcactccagcctgggcgatagggactctgtcttagaaaaaaaaaaaaaaagagttggaaatattaatagcaatctgtccagcaattttgaagcgagttattaataacggagtcagcatgatagcagcctgctaagccctctgaggcaacaggccatagggatgattcaaaataggtagaaatggtatcttttatttttaagaaaaatcacttagccccaataagctgtaggcttatagccataactttttaaaaaatgtataaggtcagatcaaaagtttttataacataatctacataaaatatctatcttcttcatttgtattaaatacaaaaaattactttacagtatatacattcagaatgtatgtccgatatgtttggtaggattcttgaaaaataaaaatttgaaatgaattacattaaattttattttacacttatattgggtatttcaaaattgtcatttacttaattttgactagtttatcagtttatatctcaatgaagagaattgtatataaaacaaatccggccaggtgtggtggctcacgcctgtaatcccagcactttgggaggccaaggcaggtggatcacctaaggttgggagtgtgagaccagcctggccaacatggtaaaatgccatctctactaaaaatacaaaaattatccgggctaggtggcatgtgcctgtaatcccacctacccaagaggctgagacaggaaaaattacttgaacctgggaggcagaggctgcagtgagccgagcttgcgccactacactccagcttcggcaacagagtgagactccatctcaaaaaaataaaaataaaaataaataaataaataaataaataaataaataaataaataaaaataaaacaaatcctccttcatgttaaatgtccacacatttgaatggattgaatttacttatcactaaatatgatgtactactctatttcaaaccgatggcactttaccactgaaaatgtaataactggatcttccataacacaaataatactcccaacatcacttaaacctatgtgaaatttgaatatcaaacagtatctcaccagttgagaaaattttattagtaatcaacaaaagaacactgcccataatgaaatctgtattaattacaaaaagagttatgaaagaaataaatcattattatgaattttattttaaaaattaaatggtttgggactccaatacatacctcttatgatgttttatctgaaggtcacaaacggaaataaactgcaaaccactgtaagctaatatcttaataaaattcatgtaacttttgtctaaagtaattaaaattctctccctagtatttttccaccaataaatgcacttaatacccactcaataattaatttgcactttagcagtttaatcagatgtttaaaaatacatatttacaataaaacaatagatattatagaatatttgataacataaaataattcaataattaaattctgaagttttccaggcactacatttttactattactattattttaagttaccttaataagtgtatagaaataaataataaattagagaagttttaggtagtgctcagtggcagtcaaaatatttatagctcataaggaatgggcacagaagaaatgttaccatgactaatcaaaacagatgctggctgtaaatacagtgtgtattccctgaatatcaaccctagctttaggtgtcaaatcaaaatccatctcttaaagctaatcaagaaaagtgaagtaatatgtagttttaccactgagttccttcccctactctcaagaaattgattctccgattattaaaaagtgtatgctccctcagtaaaaacatttaaaactttgcacagatcactgttagttctcaactccattcctatctaaattttagattattactaaaattttaaggctcttccatgtttgggtgtgtattttctattacatttttgtgcttagatttaccttttattttttaaatgacataaagtatttatacatatttatggggtatatgtgatattttgttacatgcataaaatgtgtaatgacaaagtcagggtatttaggttatccatcaccctgagtatttataatttctatgtggttttctttttttttgagtactctcttctagctattttgcaatatagaatatttttattaactacagtcaccctactctgctattgaacattagaacttcttttgtctgacgtttgtacccattaaccaacctctcttcatcctctcccaacccactcaatcctcccagcctctattatctatcattctactttctgcctccatgagatcaacattttagctcccacatgagtgagaacacgagatatctgtatttctgtgcttggcttatttcacttaacataatgacctccagctccattcacattgctgcaaatgacattccttctgtcttacggccaaatagtatttcattgtgtgtatatatgccacatttttttatccatttgtccactgatggacacttaggtttaatttcatatctttgctactatgaatagtgctgcaataaacatgggagtgcgggtgttcctttgatatactgatttctttttgagggggatactcaatagagagattgcaatagagagatctgtttttcattttatgaaaaatgtccatactgtttttcataggggctgtacttatatacattcccatcaacagtgtataagagttcccttttctctacatccttaccagcatctgttattttctgtctttttaataatagccattctgaccagtgtaagatgttatctcattgtgggttttgatttgcatttctctgatgattagtgatgttgagcatttttcctatacctattggccatttgtacgtcttcttttgagaaatgtctactcatgtcctttgcccactttttaatgcaattaattgtttttactgttgagttgtttgagttccttatatattctggttattagtcccttgtcagatgaatagtttgcaagtattttctgctgtgtttaaaaggtttaattttaaaaaacagtaacaatgacatcctacagcagttatgtgtctcttgacttcgatttattcactaaaatagtttgcatataattgatgggtgaattcctcttccaggcactctttctatggtagaagttaaaaactacaattcttagatggctttgccagaatatgaagcattggtataagatcaaaggcaaagacagacttcttcctgcctcctgcttttggcactgaaaatctcagcaatggtgctccaacagggtctgcagcacagaagtcttggtatctaggctctggactgctgattgcaacactggttatgcaagtgcagaacaatgcaagtgcagaacaacagcagccaccacaagtgactggaagctccagcagctgttacaagcacaacagaattcaagaaattacatattatcctggattcttgaagtgtccataggagtgcggacacctggcttcctacagtgcagtgagattggtgattccaacagccacagcaaaatgtggaagcagcagcagcagcggcagcataatacttataggctctggataacaaaactttcccttgctttctgaaggaatttgttactaaataatattgccaccttctatttgctcaaccagactttccaacacttttgtaatcaattccctggattgaagttcctcttttctgagtcatttctgtttgtcttggcattgattaatataagcccatactccaatatatgcataattatttataatatacatacattactacaatacatacattacagaacatgcagcaatagatattttaaaagactgaggtaaacaagaagtaaacattctaaatttggggctctgtttatcaacaattttaaaacattttgctcttactgaagagcaaactgctcttgatgctcttactgaaaaacattaaaacaaaaatttgagtaaatatgtgtcattctctacgtcttggcttggttttacactttgtaaaacagtcatctgaaaatacagtactattttcaggttacttagatataatggttgtcatgggtgcagaggaggggtggtggtaagttgagggagaaagcctcacaaaatagtaaattcaaatggaagaagagtatcaatggctgtgcttactacatcaaaataatcaattttcaatattaatggccaattatgtaaaatactttgttgaaatttagctagtaaatttccatcttcagatgaataagtcattcctataaactaagaggtgtagcgttttattttttaacaaaaggattttaaaatcaatttaaagattacatttgaaagatcttaaagtaagttataacattatgttccaagttttacaaaatatgccaatatatttttgtacaattttcaatgtatatagaaactagttttacaaatacattggtttttggcaagaaaatcacattgtaatgaaaagaattacaaacattcaatatgaaatgttttctccataaccacaggtccttcaaaaagcagttaccttctcactcattattagtactactactttaaaaagacagatcgaatatgttatttttcaaaaatatacattagagcgcatagtatggacagtcacctgtcataacagaaaaggtgagtaaaattagaaccttgtcattctgtaaaagaaaaatgcataactgccataaatttcttattacttctcaatactctaccactggataaccagtgaacctcaagtggtgcaaatgatattcatggcccattctccatcttattacaaagtatcataaagattccactaaaattttaagattctttcacatttggtaacatatttttgactacattttaaagctttaacttaaaaaacgaaaacaaagtgaccacatcaatgatgtcctacagcacttgtgtgtacttgtgacttcaatttatttgttaaaatagcttgtctgtaaaagactgaagggatttcatgtgtagaagtagttctgtaacctgcctcggcaagcttttttctattccattcaaatcgaccactccaatattctaaaactatgtaactatagataacatagattttcaagaacacactgttttactgtagggcagtattttgctgtttagccacaatcttctccagtgattattttggtgatttataacaacatagttcttcgaattatttcaattgagcctagcaaatatcattggatgaaatgttagaaatattggtactttcatttaactatatagtaaacattccacactgcataatttgttcaatacttgtttttgcaaatcttcagcaatgttttctatacatattctagcagtatttgctgacaaatgtgatagtttgttgccatattatttttcacacattatttcagccattattgctcttgaagaacagtgtttccaatggtaaatatgtttgtattttaatattgttttttaaatccccaaaagtcttctaaatattaatttaatgattttgtaaagtctgtactgagtctcacgtgacattaaacactgcttgattcatgatctaggtagttagattttaatgccttaccaatgaaatggtcttccaccatcgcacaccatacactgagggtgacattctttttcaatgacagtgaatataaatcatttcaaatagacttcttgattattatttttgatcaatgttcaaatattgctaaatcatcattgttcttactttataatgtagtttacaaagtgttcataatatgtttcagggatgttctttttcaaatgggcttggattattagtatcatcttttctatgctttttttcagtcagttgtctgttttgtaagagttagttttagttaaactaatctgtcactaatctgtgactccacataacaaggcacagataacatttagtagctccaactctttaacaaactccactctctcccatcaggatgttctgtttaagtagcaatgcatgtaaataatgctctgatattgcccagctctatctgggcatattaactgctggtaactttaacttcttagattttttaaataaaaaacacaaataacaatttttatttcctctcaaaccctaacgcatcatcttgcatatttcttggaatgcatggactttatttttgaggccactattctacagtatgggctttggactcagattttaaaaatatttattggatatgtatattgaagcaggttacttatccatgagtctcatatagcttatctataaaataagaataactatatcacagaactgtttgataactacattagattgataataagagataacatttttgtgaacatacaaagtgcaaggctctagtcaaagcacacaaaatttattaattcttgagtatggcgtctacacacaatgagcatttgataaatattagttttcttccccaggaaagagagaaagagaaagaaagagagagacagagacagagagaaagaaaaagagagcaagagaaagagattaactgttcaaaataagcaatatttattagggcaaataaagttggttgtttacatgcctatctcttccacaaaaactcaaggctcctaatcatgctgtagtcatcatgtatctgtattcaaagtacaaagatctgaatatgttatgtgctcaacaattaaataaatattgttaagtgaatatacatagggtgacaccatagcttgctgtttattatctgtaaaaattacagcaaatccagcattgacaggatgttcaattaactgcacaaccattgcaaaacatgctattgtttttgccaaattctattatactgttgcagaaagtgcagaaagggtaacactctccagagcttttgaaaatacagtactctttgattatttatactaacagatgggacataaggtatggataatccaaaaataatttgtttggattttgaaatgtgtttttatatttatatctaagcattggcatacctaatattctataagaatgaatgtactttgaacaacaaaactagagtatgaaaagctgacttagaaaaaagtttaattttaacacaaattagtttctcttatctttttccttaacacttctgtgtaacctataccactttgattactccagctacatagaactcaccttttcccagaccttatcagattatctaaatgttggtttctacaggaatattttctgtataaagcagggaattctcatcaataaatctgaaatcaagtttgcctaggtattattaaaaaacaatcaacagaaatataaaatatgtcatctgcttcaaaattaggaatttttatttttaataaattattttattcctttgtgtattacaatccattaacgttctccacaactcttttttttttcagttaagaaaccagaggtagagaaaaactagcttgtgatatacaatatttagttatgtaatccatctgatatctcacaagttttcctgtcaaattcatagtgctcttatttttttaaaagataaataaattattgtgaaatgtttaaatatagtaaaaggaggaataataaatgcaaggcatcactgtgtctcaatgagaaactgaaagattagcttttcatcttactcttaattattcatgggccatacactctatctctaggtgtatgggaagcagagtgcttcggtagaaagaacgtggcttttaaagtcaaagcctggatttgaaagaagcttccacattcactacctgtgaccttaaacaagttactatttttccagaatttcagtttcctcatagcaaagagaaggcaaaagtattaaatgagaacatatataaagtgtttaacccttaggaaatattcattacatagtaatccaatttctacctttcttcccaaaccagaaattctcaaattttgttgtattgtagatctcttttttaatttttattttttagagatggagtctcactctgttgcccaggctagagtgcagttgtgtggtaataacttaactgcagactcaaactcctgtgctcaagcaatcctcccacctcagcctctgcagagtggctggaactacatgtgtgtgctactgttcctggtttgtattatagatctcttctaactactaatgattcacatcaataattgatacttctctatcacataagttataaaatttcttcacataaactgttgaattaaatcctcactgtcactctgtaatcatactttaacctaggtcaaccagcgcacttaacattccatcaagcctgctcccctattttaaaaaaaaagtcctcaccagaactaaccgttttacactaagaaagtgacatctaatgataataaatattattaaactatttggctaggtctaaataagagcatattcacataaatatcactagtggttctaggacctaaaactttacctggtacaaatttttttttttttttttttttttttttttttgagacggagtctcgctctgtcgcccaggctggatggagtgcagtggcgcgatctccactcactgcaagctccgcctcccgggctcacgccaagtacaaatgtttttgtaacactttcctacaaaacagcttatgaaacaaattaaagaaaatatgctcacatgaaaacttttaatagctattatgattattttagaaagagaatgaccctcaaataaaatttagtatattttctattctttagtaacacattaaatttcctcagtataatttatttctttgaaaacgatattgaaaaaatagataatgtctaaaatactgggtggtccatcaaaacaagatccccacttaacctaaccaactctgagagaatagttggttaatcacttagattatcctagggccacctctcaagaccacaatttaaaaatcatttattgatcctttaccttctcttgaatatgtttcttactaattagaaagaaacagagtataaaagttaaaggtatgtgggttctgattcagattgcttaagttcaaatcttggctttacttttaaatgaattccttaacattattaacccttttgtactcatcactaaaatgagggaaataaaaggacctatattatagagtttttctgatgattaaataagataattcaagtactggtaataaaagttgctaaaatttatcaggcattttaccatattcagacactgtgctaaatattttatacatattatctcatctaatattcacaaaaccctgtataatatatcttatagatgagaaatgtgagatccaaggtgccacaactcatacaccagaaccatgattaaagcacactaatcctacagtacaaacacttagtgctaggtacatgggaagctcaatgcctggcacatagaaagcattcaataaattttagcttgtgtttatttctattttatctaaataccaatttatttgaaagttctaaattgaataaagtagttctcaaatattcaatttcacgattccgattccttgcttttaccgtatccaaccccactgttctaaaacagagagagagaaagcacacaagcaagagtgtaatactgtgaattacttatatgacacttagctaataaaagtcaatagatggaggagtctttaatgcatattactaaatgaaagaagccaatctaaaaggctacatactgtatgattacaacaatatgatattctggaaaaggcaaaactatggagacagcttaaaaaaaaaatcagtggttgccaggggctgggggagagagggatgaataggtggtggacagataatttttaaggcagagaaattactctgtatgagtcttataatggtgggtacataatattatgcatttattcaaacccataaaatgtataacgccaaaagtgaatcctaacataaactatgactctgggtgacaaagatgtagaaacgtagttcatcaattgtaacaaatgtaccgctatgctggaaaacgttactaatggtggaggctatgtatgtggcggtaagatgtgtttagaaaatctccgtatcttatgctcaaatttgctgtgaacctacaattgctctaaaaaaaaatcaagtctattaaaaaatttatcatgtagtagatcttgtataaagtctcaacaaatatcaaagaattaacatcatacaaactctctaagcacaagcaacttaagtaaaaaattaacagaaaaaaattttttgagtcaataggagttattttgggaacaaaacacaaagtaaagacttgaggggattgaaaccatcaggatgaatgtaagccagacgggggcaaattgcagaatgtcaattgccttaacctaggaaaggtaaatttctaaaaatgataccaaatggttaaaaatcactaaatgaggaattgaagagaatttcaggttagaaggttgtaaaaagtgaaataattgtccaaagtcaccaaactagttcacgagaaagctggaactagaaactcatgcctctcaatccagtgttctttccactgtaacagattggcaccatagaacatgtttgactcaaggcagtaaattaagtacactgaagaaaaagataagaaaaaagtgataaaatgtaaagtctttgattcagacccaagtattacagctgctatggcaaaaaatagccacaatttctaagtgactttaaccaggaaaaaaagaaagagatgagatttgaaaaggaattaaatttcaagaatcaacaggaagtgatgacagccttccctatttggtagtttcaggcctgaacttttgtcattaaggtaataattcaaagtgctttaatgcctggactgaccacactaaataacaaaattataacccgttgagctacggtcagttttataaactgtgcctaaaatttcctgagttcaaatctgattataaatgggcaataaattcatctgttcattgggctgatttactttattttctgggtgcatttaaaatcttttttattgtggaaactttcaaacatacaaaaagagtacataataaatgattcccttgtacccatcattcaatttcaataagtcacattttgcctttcaaattttacctattgccactaacatcctttttttttctggagtagctgaactgatttaagatgaaggaggaaaaataaaggatgaaaggaatattttcaatctgttattcattgatactctagccaaaaagattccagattatgaggcaaaaagaaaaaaaagacaagagtcaagaagtcaagaataatgaagttgaagtctactagtgagatggtctagatgcattacttcaaaataaatggaactattgtctatgggggaggagattttaacaaactattttccaataatttaagtttgaccaaagaaaaatggcagagaatgttgtaaagctttattgatattatagtttatagagatgggcttatcttcaaggaacataatgattaatcacatcatgtttaaattcatataatcgctaacttaccatattccagtaagcacctataggaagaaaagtttgcactattcataaaatttcaatataaccaagtcttagtttattcttaaagctcaaagttcatttttatttcccttgaagtctgtgtttttctgtacttgagaaagatctcctcatttttaaatttggaaattttaaattagaatttaaagtgactttggtcaagttcagtggtcttttttaagtaatattaataaaattacatatttctggacctcgaaggattcttctgagcatttagaatcatactgcagtttccagactaaacactttagccagagactatgagaagcaggcaatgaggcaaatacaagcatatcgaaattatcttgatcgaaaagaaaatgtggataatgttatgctgaaccgtcttaatttctgtcatgaaacaaaggggaaaacttggcaagtaaagatgagagatgaatttctaatgggggaagaggagttaaaactgaaataactagtgaggcccaactaaggttttaaagcatgaatctaaataccaagatttttttttcatatttggttcctccctattgacttttgattgcaagaccaatggacagcgaccgtctaattctcttctcttatcttccttagcaaaatgttagcatatagctgtctcttgcttcccattctcccttaaatgtaaaaaagttcctcaaccaaaaaattacttcctacatttcatataaatcaagtcaaattatgtctccatacaatcctatatctctgaggagatccttggttctccatggattttaattcagtcaaaatgtgtcacagtccctcagtgcctttatttgtcctgcctctccataaaatctaagctctgccttcccattgaacatttgtctatgaagactttctatatattaatcctattcttcatctttctgaccatacattcctaaaatggctacacatcctgattaatacatttctatgcattatagattacccattttaagaacctcagtgtccaccaatcttcatcacctactggcaatcacctttccacaagcctacattgacatagctatatcatttaccaactactgctcactcctccaagttctgccttgtctacagactaattttcagagtcaaacacccattcttgaggcaaacacgtattaatcaaaaggtcagaacccagtaaattacctggaaactccaatcactgtgaaaaacatgcatgatttttcataaaggtctaattattgctctttttttcaaatgatctgtcacaggctagttctgtgtgccatgctacaatacacttctttctatggcatccacttgagctcagtgaagattcttctattttctcaaatttacattcccctaagatatttggtcagcaaagatgagaaatattaggactctcattaaacattagcactttgccattatctcttaatatttttgtgggcacctattttcattccatcccagaaaaacttctttccctataccattttcccttcacataatttaacaatatctagaatagcacattaatagttgaagatgttctaatgtatgaattattactaaaacaattatttacctatctgatcatataatttattttagaaatcaaaatagacacagagaatagaaaacaaaagaagtaagcattctagaaacacaaaagaattaagaatggaggcagattaaactgtcaaaaagtgtttctttactagaaacactaagcagaatgcttgtcaattctctgacaaatataccactttataagctctggacacctgagaagagaaaatggcaatgactgagggaagttcctccagccaaagctaaatatgacctaagacctgacatatgtcacatacacaatcaacttactgctcaaaaccagtaaacacacatccaatccatcatttctaaggcacttgtacatatttctcaacggttatgtaccttatattctttattccaagactggctttgatgctaatgtttgacttcattctcctgaataaaaatacgtggcactagtacaggactgaggagaggctggggtttctaaactatcaaaaagttagttctgtttaaggataactcagtaaagatttcacaaggcagcattccttagcactacccgaataaaccccacataaacaagctaccaagccacctgaccactcttggcctttgtttcctcatcaataaaattaggataataatgttaactacctcatagtgttgaaaagaaccaatgagttaaaatatgttaagcacttaaatgttgtctggcatgtagcgatattaaagagctaaaaatggtattaataatacctgaatggatgttatttcattgagtaatttagatttatacaaagttgctaaaaagtaatgtaagtgaatagtatatgttttatgctttgttaaattaagaaattatgatatcaacttagagtcttaaatatactgaacttgtagtagtattccaattgaattagtttgaatattataaggttgccattacattttgttggggcttttttcctttttatcccacaggttgacatcatcaacaaatgtaagccaaacaaagcagttactgtaagaaatgctttaaataaacctaaagacattttaaaaaatacatatgcattgataactaggttgtatatataaaaaatgaagcatgttctttctaaattaaaatttagcttggggaggagtgtccgacctttaagaaaaagataaaactcaagaaacaaattgtaggatacttgcccaaccacatataaggacttactgtaaagctgtactaattagtaaaatgtgttactggtatagagatagtccaatcaaccaagaaacagaaaacagagcctataaacaggcccttgcagatacagacccctgacagacaagagctggcacggcaaatcactgaggaaacacaagaacatacagtaaacataactggaaaacatgtttctctatagaaaataatttaaacttttatgtctaaataatatacaaaaatcaactcaagtgaatgatttaagaaaattaaaaagcatgaaccattaaagaaaatctgtatgagaacataaaaattaagatttttatgtttattagaataccctaataaacataggtaaacacgagtttacctataaacaaaccctgtgacacgagtttacctataaacaaacctgcacatgtacccctgaacttaaagttttttttaaaaaaaaaaggaaaatgtgatatacaggccaggcatgctggcttatgcctctaatcccagcactttggaaaaccaaggcagaaggactgcttgaggtaagagtctgagaccagcgtgggcaacacagtaagaccccacctctccaaaaaaattaaaaaattaactgagcatggtggcatgcgcctgtagtcccagctacgcaggaggttgagacaggatgatcccctgagcccaggaggtcaagacaggagtgaaccatgattgtgtcactgcactgcagcctgggcaacagagcaagaccctgcctcaaataaaaaaaaaaaaaagaaaatgtgacatacatacacaatggaatactattctgcattaaaaagaagaaaattctgtcattgtgacatcaatgaacctgaaagacactataccaagtgaaataatccaggcacggaaagacaaatacagcatgttctcactcatgtgggagctaaaacaatgaaactcatagaagcagagagaatggtgactaccaggagatggtgggtggggagatgggagagatgttggtttaaggatataaaatttcagttatacagaatgaataagttcaagagatgtacagtatggtgactatagttaataacaatgtattgtttgcttgaaaattgctaagagaatagattttaagtgttttcatcacaaaaatgtaaggtaattgcatgttaataaacttgatttagccatttcataatgtaaatgtattctaaaataatgttgtacattaatgcacataattgttgtcaattaaaaataagttaaatttttacatgtagaaaataaagctaataatcattttttaaaataatacacacatacatacaaaaagaatgccctaaaagaagtgaaaagacaagctacaagggagaagagatagaattagtatctataatataaagaactcatgcaaacaatagaaaaagaatcatacaaatttttaaaaagaagaaaaataggtataagaaccaccatttcacagaaggaaaagacacatgtaggaaaacacacatatacatgttcacagccttgtttcttgagaagcaagaaagttcacatcaagactactgtaaggtattttttatttactcaggtggcaaaaattaagaagtctgacaataccatatgttaaagagaatatgggtcaacagggatattttatacaatgctggtgggagtgtaaatggctaatatcattttaggaaaacaatttgacaatctcctgcaaagtagaccatttatacatcttatgacacagcgattccaatctcagaatatacctaaaagaatgtcctccaaatgtcaccaagaaacatgtgcaagaatgtttattctagcaccattcacagccacaataaaagggaaacaactcaaatgtccattggtagaagaaaggatagattatactgtggtatagtcacaaatattatatagaagtgaaaaggaacctgtaagttacaattacacacaacatgggtgaatcttaatatcttaatgttgaaaaaaaagcaaattctagcagataaatacagcaggctattaatgagttattgagctacagctaataagttaataattggtattatttgtgaccatctgcaggagtaatattaaaagtttataagtggtaaagctgtattatttatgaaaaaatggaacaataagcacaaagtttaagatagtggttacttctggttaagggaatataggtgtaaggaaatgtgagttttgatgttctaatactttggttaggtcttggactcacaggttatttcttttgatttaaaataacaaacgaatgaatgaatgaaagaaaaaaggagaacacatggaaaaatgactatgaactatgttatgattcaccaattctgtgtgcttaaagtccaattcttttaaatgacaaatgatttagtagtacttctcacactttctgtacatatgaatgacttggagtcttgttaaaatgaatataattattctttaggtctgaagtggagtttgagattctgcattttaagcttgtaggtggtatgaatgctgccagtccaaaaaaatctatgttatctatctagtcatttccaaatatgaggtgctggggaagctaaaaagattgattgagactattcaaggcaacaataaacgtcaagccttgttaatgcaaaagtttaaacaagtaagcatttttattcagacaacttaaatcttagtctttaaaaaaaggaacagttcaggtgtggtagctcacatttgtaatcccagcactttgggaggctaaggcaggcagatcacttgaggttaagagttcaagaacatcctgaccaacatgacgaaaccatgtctgtactaaaaatacacaaattagccaggcacgatggcatacacctataatccatcccagctactggggaggctgaggcacaaaaatcacttgaacctggaaggtggggattgcagtaagctgagatcatgccatgcactccagcctgggcaataaatcaaaactctgtctcaaaaaataagaaaataaaaataaataaattttaaaaaggaaaagaaaaaagcaaaaccacctccattgttttaagactgagcatcagtgattcaagaaattcagagacttgaaggagaaatcaaataaactcaactgaccgctgaataagataacaggtgtcatattttggaatgtttattacaatgctaagaaataattatttgatttctgtctattccaaagagaagcaggtcttgatagaagacaccagaattcagagtttatgttgaaatgaaagacacttctttcctaaattataagaaactgaaataataagaattaagagaagatcgctttggtttcttgaggattaaaataaacagatcgctttaatttcccatttccttggtgttctctacaaaactgcaactagcaattgggacagtgatcactggtggttagaaattttcttgaatagagaaagaaaaaaacaaaattaagagatgactggcaatgacatatgcatccaagaatgcacgcaacatatattaataggtcctactactcgagtaacattagtattattgagaaacagtgaagaaatatatttaaaaatatgtctatctcaattgctattaatttcacatttaataaagataatcaatacacaagtagaaggtgaaaacgggtttgatttattacaatggattcattacgtgaaagatataatatcaaagagaatcagttgaggtagttgtttctactagccttgcctaaagtccatttacagaaatgaaaagcaaagattgcctgcatgtagtgactcacacctgtaatcccaacactttgggaggctgaagcaggtggatcttctgaggtcaggagttcaagatcagcctggccaacatggtgaaagctcgtctctactaaaaacacaaaaattagctgggtgtggcggcacatgcctgtaatcctagctactcgggaggctgaagcatgagaatcgcttgaacccaggaggcggaggttgcagtgaaccaagatgacgccactgcactccatcctgggcaacagtgcaagattctgactcaaaaaaaaaagaaaagaaaagaaaagggaagggaaggggagggcagtggaggggaggggagggcagtggaggggagggaaggggaggggaggggagggaagggatgggaagggagaaagagcaaagactgttgttccttttaagatctacctttggcagggcacggtggctcacgcctgtaatcccagcactttgggaagcccaggcaggcagatcacgaggtcaggagatcgagaccatcctggctaacacagtgaaaccccgtctctactaaaaatacaaaaaattagtctggcgtggtgtcgggcgcctgtagtcccagctatttgggaggctgaggcaggagaatggcgtgaacccgggaggcagagcttgcagtgagccgagattgcaccactgcactccagcctgggcgacaaagcgagactccgtctcaaaaaaaaaaagatctctcttttcagctttcttataacatcatgtctactactggaagaatagagaatctgaagaagattaaactagttaaacatattttttaagaatatttatgaaaaaagtaaaagtcaaatgattagggaaagaaaattttaaaatggagacatactttggaaaaagagtccggtataatatatttagacttagacacattcatccattcaattttctccaaaccagaatctaggtatctttaatagtaccatacggtacagactatagtgtattaagatgatacttacgtttcttattataaaagaacgtctaagtttttagacttttatagtggtgttatcaaccaactaatgtaggtatttcctaatactctcacaaccaaaaaaatggccaatggcaaattaggtgtctggtaactgaaagatcataaagattttactatttcaaagcatttatgctagagtcacttttaagtacagctataaattacaaggagataatttccaatgaaatataaaacagattacaaagctgtatttagctgtctgtggccatttaataagtcaaaacataatgcagcattatcattacgtcaagatgtgacaaaggcccagacttcccacaaaatattcctgtctctatactagaataagacatcatcagaagtacctgaataaaatctcccctcaatgaccagaaaaataaacgaagaaattttagagacctatcttagactttcagcgattaaatgtactcacaccttccatgcattccactcttctatctgttggaggtttatatagcttcatcagtaatatgttctattgctgacatatcaaaaggcttaatatcacacacacagcttcaaatatatatataaatgtccattaagtgtaaaaaatgccttcagattttcattatcatcactgtatccacatcatgctttttcaagcacttcaacattattttacttgactctcacaaagattgtgtaactgaggaaaatatctctattttaaagataaagatcctgagatacaaaagtcaagtgatttgcctataatcatattctatgctgacttctagggtttttttcatctaatatctttaaattctttcatttctgcattctgttactttgttgaaatcattattgtacctgtaatctattaggtcaaatcagcaaatatttatcaatcaacttctatgtgcaaggactcaattaatgtgtaattggcataattaacttatttgtgacatcaacagggataatattaaaattatttaacaactgacacaaaaggtaccaactaaagaaactgaacactgaacaaagtgaaacatacgctctaagttttatcaagggatatcaactgcatgtcagctctgatgtgggcatgaccaatagagtctgatttaatcacaaactacaaatcatttgtagatgtttatttggcctgaaatgctagaagaacatctgaagatttaagagaacatgtagaaaattctggtagcacgtggtccaaaattaacttaaagaaaatgcaaatataaaggaaaaaaacaatctgcttgggtgccaagattcagaaatatgaactcattactaccaaaactagccataatattttaaattattttaatttctttttttgtttgttttttgagatggagtttcgctcttgttgcccaggctggagtgcaatggcaccatctcggctcaccacaacctgcacctcccaggttcaagtgattctactgcctcagcctcccaagtagctgggattacaggcatgcaccaccatgcccagataattttgaatttttagtagagacagggtttctccatgttgctcaggctggtcttgaactcccgacctcaggtgatccagctgcctcggcctcccaaagttctgggattacaggagtgagacaccgtgcccggccaattatttttatttatgcatttatattcaaatatacctaattttaataaaatacataagtggggttttgaacatgtttttagcacaacttttcttttcctttatttcttgggtatctgctcctctcctttcatatttcctctcataaatagttatccatttttataacttagtatgcatcctgctacattcttcttcctttaaaaataaccctactataaggtagatatatacatatgcagatattacttataaatatacatattcaaggatctttgtaattattttttaaaggctgaatattatacacacttttctataccttgctcttctcactcataagaaactcctggaaattctttcagaagatctgagatagctttatttcacatcatttaatgacagcataatagcccatggttgagtttccattatttactagcattaccttgttaatgggattactattttctgcagttttaccactacaataaagttacaacaacctggaaaccaaaaaatacacatgttcttaaatattgctacctatatttctatggaatatattcccaaaaatgagactgccaggttaaagtatttgcaaatcatatgcaaattataattttaataggtttttggtagtcttacaagactgcattttataacaggtagaatatatcacatttccaccagtaacaaatactgttaaggtgcaaaatgggaatatactttcatttttttacatggagatcatcagttatgccagtcccattaatttaaaaaatccatcattttccaactaagttgtcatctttttcagaatttgccaatcatttccactgatctattatgtatgcctaggccatgaccatgttgtttagatgagctgactttgtaatatgttctggtatgtgtaatacaagtccctcctcattgctttttcatatttgcttgcctttcgttaccatttaatcttccaagtagttttaaaataacactgttgacttcaaaaaagaaaaaaaaatctcccaagattctaattggaattgcattatataatttattaactttgaaataatatttttattgttttcccatcctaaaccagtttgtccttctcttaatcagatcctgttttatgcattttaatatctttgttttcatatagttcctgtacctttcttgaaaaacttattaataggcattttgtaatttgtgtttctatggaaaatggaataatattttcccattgggaaaaaaagtctcatagatgcccaaattcctccagagcagagttgttttcatcttatcttttatccaactaccttatcaatttttcttactcatttttctagattttaaaattcaagtttctataatttttagaccatatatcatcagcaagagacacctgacattcttctctacaaatgttaatgttatatcatttaccaactgtatatgataaagcctctaaaataatgttaaataattgtgatggttccttgtttagtttctgttgttaattaaaatgtttttaggatttaacaatttaggccatgtgcagtggctcacgcctgtaatcccagcactttgggtggaggctgaggtggcaggatcacttgaacccaggaggttgaggctgcagtgatccctgatcatgccactgcactccagcctgggtgacaaagtgagatcctgtctcaaaataaaagacaaaaaaaaacccccaaaatttagaataccttttgccatttattgagataaacatgatttttctcctttaatttgatgatgtaataaattaaattggtatatttcctattattgaatcatgcttacattcccacttaaaaatatattttaaaatagctactagtgagttattattttgattcactgttaatattttctaacattttccttagaattttttaatatacttcgtaagtgaaattatacattttttactatataatctttaacagaattagatattaaattatggaatattttgatatttttccatggcctagaatgatttaaattacatcaaaattatgtattccttacgtttaagtgacaacatctggtcaaatttctaatcttttctatgctaagtagcatctgctttctacttcttcttaggtcaatttttatcatttgtatttgactaaaagtccttttatttctcaagggttttaaatttgtcacacagctacattcttatttaacattcttttcatcttccagttttttcttctttttcatttctaattgtgtacttttgtcattctttttcctaaagctttattagtgaattaaaattcatataacataaactcaccattttaactgtattaaagtatataattcagtgacattcgcaaggttgtataaatatcaccaactacctccagaacattctcatcactccaaaaggaaaccctatacccattaagcagtcactccccatttttccttctcccagcccctggcaaccactaatctcctttctgtttccacctatatgcctactctggacacttcatataaatgaaatcacacagtatgtagccttttgagtgtggcctctttcactgagtatgttttcaaggttcatccatgttatagtatgtatcagtacttcattattttttatggctattatattgtatagatatatcatagatgaataatttttattccttcattcagcagttgatggatatgagttgcttccactttttggctactatgaataatgctgccatgaatatttgagtataaattttatgtgaacatatgctatcacttctcttgagtatatacctcagagtggaattgacaggctcattttcttttttgctttatcatcttcacaaggagtttatgtatcacattgatctttccaaagaaccagcctttagatttatttcgggttttactatatggtttttctatttcattactttcatctttctaacaatctcctcatcttctatcttgtattattctttatactaacttcttaacattaggttatctttatcttccctcttccttaataacaaaggcctttaaggccatcaattttcctctgacaactattttagctaattttcattggcttttacaaaaaatatttccttttcattgctttctaggtgatttcctcttcatccaaaagatatctgggaatgttttaatttctatgtagatttttttaaccttttagaaaaactgttaaaatttgatatatgttagcttacagtcagagaaagtgcctgcaaaatctctgctctctaaaactcagttttcttagcagccaagtgcagagatgctcaaaaatatttaaagaatgtcccactgtaattcctattattcacgttttgatttctagatctatcctccaaatctcatcttttttttttcaatatttcatcatgggtttttttatatgcttggatacatttcttgcatttggtcttttcattcactaattcatatttcgacagtgactatgctctcccacaaatcctgagttgttcaaatgagatatatttaatatctgaaattattttctgttctttgaatttccttaagtgctcccaatttttgttttcaaattcagttttcatgttttcgccagtagtcctagttacctggagtgtgtactctgattttcctctctcacttgctatgggtctccttaaatgaattgctatttttcgctaactcactggagctcaggtctggttgccagattatcctaaatggcagaaatatcacaggtggtgaaaagcaaaggtaaacagcctgtcagttccctgcaaaggcacatggacaaagagctctgttgtcctatctctatttctttttagcctccaaagacagagaggactccaccaggacattcagctactttagctttttagcagctagcgacacttcggtacttaaaatggataaatattgatctcctcctacaggagttcacaaacctctaaagcccaagctcttcgtcccaatgtctattgctttctcatatttacccatggactccagcaccattctccagttgcttgcccaacagaaggcagaagtttcaaagcagtgtttctctgcccaaggtgtcatgacagttgtttataggtcacagcagccatttgcttcagaaagccaggcagcttggaattggaagtgaagaagataaccatatatagctactttgttttcaaagtctttaattttaaaaaagcctggggtggagtggggtatgtgggtgtgaggtatgtctggacttcattatacttattcctaagaatcaatagtttcctcagaaagcatattcctgaatatataaaatgacaatatgttcttctgcatgctctttagattgaaatcgtgaaatacactccagctattaatcactttaagtaagctttaatgcaatcccagttttaattattccaggacttaattatcttttgttttgaaaacaacttcaaatcaatttgctgtagtttcagttagaaagacaaattatgactttagccaatcaagtctgccaatgtctaacaagttttataaatatgaaaaagtatgtcagctatttatataggaattacatgtgtcccacatgtggtttacacgatgttaccctctatattgttcacaacccaactaccttttttgctttctagaagagctaagtaattatattatattatcactaatattacagtgtttaactggataagacttctaaaaactcagataattaggtaaaataattaaacctattttttaattgtgtgaaattttatgaacattccttaagaattagaaagctcatataaaaagttcaaaatctcaattgcaatctatgaattacaaagcatagtgtgctttgtttgtccctctatccagataggaatcatataggatatgaaatatgggtttcatccttaaatcagcagataatataattctgtgtactctattcaacacaatatcctgaattgattgtagtagatttgctttaccactgatgggagatacctgacacatttcttttctgaatcatggtaaatgtaattttattggaatttttgccatgatagaatttcattaagtacctaaaaggatagaaaactgtgagcatgtacaaacacgttgggtcttggaaaagtacagggaaagtctataataggtaataattttaacaatgctaaatttgaactccaataagtaaacggatagcctagtaaggaaaaataattttcccaggataagtacaaaaaagcctgatcaacattgaattcctcctgtgtgccagatattaggctaaggactaaagctataaagataaataaagcatggtacctgttgttaaggaactgcagttaagtgtactataattctaaatgttacctttcctaagtgatgaatgtcaaagaatttaagttataagttaaactgcatataaaacatcacactgaatcaaactcactttacaccagatgcacccatttgtgcattataaaactcatcattacacatataagacagaaacagagtaatgcataccccaaatgacagaaacaaccatttatttttggctcttatacactttggtaattcgcttaacaacaaatgttgagactgtaatgtagaatatttgaatcagaagaacctagaattttgttcatttttcccatactgcttttcagctcaaatgacccctttaacacagtattgccttgctctcaatccctttctaaaacaagaaagattattaaaaacatgagtgttcaaaggtatttctctgagggtcagatgtataaaggacagtgagatacaaacaacatagctgttaagaacactaggtcccacaggctatcaaaattacaagaacaacagagtaccaccgatgatgaacttgaggagaaaggtgccatgcactaactgaatgttgataatttttctaactttaaaatacatttttcagtgatgtatccatttgaattatataaaatgattattatactatacttcttaatgcattaaaaataagagaataaagaaaatatcagatattctcataaggaacagtaaagacacataagggatggtatagcaatttcattattctttgactgcattcagatgatacagcttatatttgtaatatagcttaacagtaaacattatcttttgaaaactttttaagtttttagtaccttgtatacaaagggtatatgagtatgtatgtatacatgacagaagtacttggttggaggtcatttaaattatctgcaataaaaattcactttaaaggttactataattccttttaattcatgcatgctgactatactaaatataatccaaagtcatgtacactgactttacctgaactgatttgagactactactctgatagaaatgcatttacactatcagataaaattaaatctttctttcagtatagtgacaaatcaaggaaaagttaaagtacataataaaagtctagactgtattccactcaaagcatagtagaggctgttttaaaattccatgaatatgggaaggaggagacaaaagctaaattccataataaataaaacaaaattaaggtatataatattttacccctcatatccatcacatcctcaagaaagttaacagatgttttcctgtttttgaaaattggacagcaaacaacaatgtagattataaatgttcctagaacagtgatttccaaattgggtggcacacagtaggcattcaataaatggcttaccacacagattgtgctacattgcatatctttgtcatgcacttaaacttactgcctaactctaggttaggactgatgatcatgtttttgtgccaaaagcatagcagtctttgttttcgaaactctcagtgacccatatttaagccagctattggtttctgaaacaaatgttaagggcacaaagaacaaacaaacacaaaagccttccaaagtcataggatttgctaccctttgaatatactgtttctagtctccctcacccctatttctgcatgatacctggttcttggttattcagtcgggtttgatttagttttcctttttgacctctaccttcccagaactttcagtaatacttcctttgtcctgctcctacccatgatttccaaggcctgctttaacatggtacccagctccactgttgcaaatagaactaaatcaggcagcagttagagtctattcattgtacaacctttagacaaattctctatcatcatttttaattctagactgaagagttatattttaaaaagattctatcacagcaaccattgttcctacttacaactctttcaccttgtacccttctctagaaccttctccaaatctatgcctttctgaaataaaattgccattattaatctgggcaagcactgagttaaaatcgtcccagaatagtggtctgatggggtggtgattaagagcttaggttctccagagctgtacttgagtttaatttcccatgtgttttatacttagctgtgtgactttgaacaagatacttaccctttctgagccttcgcatatctttaaaattgggataataaaggtacctgtctcacgggattgtggaattaactgaaaaaatgcagatataaccaatgactgcaacaaagtaagatctcagtaaatgttggctactattggtgttggtggtgtgattagtattcctgtttaatacaaggatagaatgcatttacttttcactgtgcttcccactaataattttgctagtctttttggtactcatggctttagaagagttacagtgattcttcaatatgtatactgggtttcagttaacactaaaaccagcttcccttaagcacatttagaatatcttttccattatttgcatgcattgaagcattcataccaccttttgggtccaacaattgatctaaaattattcttacaatttctcctgattagctagatgtttggtaagctaaaatagcttaccatcatctaacagacagtatattttggctacgaggtgatttataaaatattatatgatcagtaccaggaacatctggagctgtgggtggatgtgaggaaatgagaggattcaggatagtatagcttcctgcagattgctgtttccatctaaggtaatgttagatagctttaagcctttcactaccattcatactagcaaaaaggatgagtcaattaaacagaaactgagagtaaaattttaaattagaactttgaggttatcattaaagatatatcaagtaggtatatagaaattgtatatagttgtttctttcaatatataacaggacaatatttgcaaagtcttttctaacagattctttcctagtcagatttctttgcctaccttatcttccttcctatgtaaatctatctgtgcatggatataatataagatcaaaaactaaatgcagtagttaaaaattaccaattttataagatctgcatggaggtggttcctgattactcaatgtatacctatgttttgcttagagaagagaatcacaaaaccaaatttatcttttatctttgaataaatgtatctatctatagattttatagaaatagaaaaatgtgagttgattcattctgttgttacctgcatcctcaattttaacaactttatgctgcatgaaatgcagagtcaagtttacaaattctattagcaatacaccttcctgagttaagatgagttggcaaagtatttatgtaaactaatagatttattatacttacccactatgaaagattataagtacttaatatcatatatctatactttactagtgtgctatgttagaaagcatgtatcattaaaattaaacttttataaaagactaaaagtggaaagcaaagtcaagtattttacatatactgtttctaggtgtcctaagcatcagtttcagtaacactaccagaagctaaaataacaattcaattgttgaaggaaacaaactcagatgattagaactgaaaatgaccctaaaaatgaaaaatctaaggtgctaaggtggagatccgcatagattatgcaacatgccatagatcatgtaactaattaatggccgcagtagaactagaacaacctctactaacttcacatctgagatttttgacaatgtataacaaagagttgaatttaatatatgagagattgaaaaggtagatattgtccccaagttaaaaatctttggatgtaattacttctacttacttaattttatattcctaagacgacacatttaaaatagcataaaactgtaaaaactcgttagaagtaatgaaaactacaaacaaaatttatgctttatcttaaatcaaaaccatggaaaaggccattttcttttgtctaaaggaagcctgagatttactgaaaatgtgtgtgagtgcgagagagtgtgtatgtgtgtgtggtggtggtaggggtctttgttttgttttgttttgtaaattgttagagattgttctattaatagtttccttttgtaatggtaatctgtgctccaaaatgagggcacactaaaatgaatttctgataatttataaagcagtgaaatacaaatacatttctagaaacttactaatgacagtaagaaaatgggtaccaagagtttcaaaattaaaaatcaaaatctttttaatattatgttgaattagaacatctttttaaaagccaaaagtaattgaaaagagattaaattggtacactcaactctctaaactgtgtgtatatttttcttaaagtgcatatctgtgagctgacagtaaagacaggctggctgctttgtttgactatagttctgtttacctcatactgtcaagaatggattttgacacagtattaatattgctatttttattgatataattagcactgctataaataatttcttgtgctgccatatgtaagtatatcattacaatcagcagtatttagtgcttttcttatatgacaccttgaaaacagactgttggcccaaagaacaaaagtgacctcatgatatgggaatcactgaaaaaaacattgccctgtcaatagagactactgttttgtgtatgacttcactaaacaaactagtttatatttgtttgaaactaaagtttctcaccaatctgctgtttcaatttcacatcacaccatattgtacctaaaacaggcaatctggattcctgttgctactttttcttcccccaaacagctcaggaatgggtttgaaatacaaggcttgaatacataaagcaaaataattaagacacccaaaattcagaatgggtgggtgaaaacaagtacacttgaaaccatttgtgtaactactagtgggtggcccactgtgagtttttgattatatgaaagcaaaatcaaaacatattttatcttgcctctagatcacatcagctgtgacaataacctcatctggaccttgaatagtttgttcataaaacaaagtagggtgactgacccagtgcatattcaacacagagtatgaaggccaaaagaaaatgacaataccattcaaaacaagtttgtggaaattttagactagtatattaaaacctttctttgtctctatcacttgacagatggttagccttcacacagcctagtatctctggcaaagaaatgactgtgtctagccaataacaccccaaattttgacttaaaatgcactgtacacatgcttagacttaccttacaaatatgaatattaataaacttagtcatgcttactttattactataaaaacttgatagatgtcaagatttcatcttctgccgttaaaaataccttcttgaaactcaactatcttaggtggatataaggttccatgaactctgcacttcagatttcattcatttcacaggttggctggtaatcatgcttaaaaaaatacttccaaaataacacttcatcccaaaaatataaaatttatagaaatttaattagcttgtgtttctatgctatccataggaaagttttggtaacaaagtggcttaaacaaaatcaccagggaaccctgaatacactccatgtcaaggaccacaggcaggactggaattatttatccagtattgatatgtctttattcaaaaactgctcatttataaatatatactcacacacacatgcaaacacacatcgatcaaccatccttaccagaaaacaggaaatggtcttactttttaacattcaattagccattcttccattttgctctttaaaaaaaattcaactgaggctgggcacggtggctcacacctgtaatcctagctctttgggaggccaaggcaggcagatcacgaggtcaggagatcaagaccatcgtggccaacatggtgaaaccctgtctctactaaaaataacaaaaaaattagtaggacgtggctgtgcgcgcctgtagtcccagctactcaggagactgaggcaggagaattgcttgaatctgggaggggaggctgcagcgggccaagattgtgccactacactccagcctggcgacagagcaagactccatcaaaaaaaaaaaaaaaaaattcaactgaaacaatgtattccattagttataaagtctgtttcctcctaaatcttcctatttatagttttcagatgctggcaagtccgtatacaaatagccagaggcaatcacaaactgctctaaagtgcattaatatgtacccttcctggaagaggctgattatgttccaaattagcataaatagagatctaatgtaggtataagcgtgacaaaccctccacggcacaggatgggagggctggaggagggaggattgtattaaaaaaagttattccacttaagaactaaacttgtatttggctaacaaagtaagactcaccatgacagatgggaaaaaaaattaaaaaggaaaaactgttatttgagaactatgaactaggttttggaaaggtgagacacccactacttgaagtcacaatctcagcattaaatcatatactcatttaaccaggtaccaactttccttctattagaaacccaggatttttacacctacagactaaatgattaaagtattgctaaaatcttctgtaatgttcctcttgcattacaaataagtctattaaagcagaaaagtgccaatcaaatgcttttgaaaaaatggtttaaataacaaagcattttttgcaggtctctcctctttaatgtcgcctataaactaattacaataaattttcaccttctcttgataaaatcacaactgaaactaggcatggtggcatgcaccttagtcccagctactaggaggctgaggcaggagggcggatcacttgagcccaggagttaaagtacagcctgggcaataaaaggagattcccatctcaaaaaacgaaaaagaaacccagaactgaaaaagatttaggtacttgatttttcagatatgttcctaaaaacaaatcccaaccaaaaattaacagatattctagcttttgttttaccatactttgctaacgggataatactatgtaggaattttatagtaactttcaagacacaagatttttttaatataaagcaacgttttattaatttcaaagacattattaaaatcatgaaaaaaatccctatctgttaaaattaccaactgaaatatatggagaaagtttcatgacaataacaaaaggtacaaataagaaataaactaagatctttctttcctatcactgccaactggtaaacaccttcctccttctcaaacttctgtaggctctttcaaactgtagttcctaagacaagaaagcagctaggttttaaagtttcattaaaaaatctcctcccctaacaatctaaaatgcacaaagtgtgtgtgacattagaatgtaagctccacaagggcaggcaattttctctcttgttcattattacactccaagtgtctagaacaatatgataaatttaaccatccatttcagaaaaatatgattatttcagagactaaagcaaagcccatcaatctctacttccgtattccaaatgtttttgaagaagtctctgcttgccactgattctgtgaagttattcaaaataatatgtaattattttataaattatagatcgcaggaacttagctgtagcttttattgcccttctaaaacaacctaattattcagactggcctttttttctagaaagtccaatttacctaattattcagactagcctttttactagaaagtccaatttgtctaaaaagtcttctgaaaactttcactaatgcaacaaaaatgattcgcttaaaatattttttccttagattttcttcctataccaagtagtcaaattcttattaacaggacaacaagaggaattagatgtttgcgggcctcaaaaactttctgatccaattatagaagaaactggcatcacatcaactggtagttctaaacacccccttccccaattatagccctcacatgaaagtttctctttcctctagtattccatttaatctcgtattttcttttagtagctagtcaatgtacacatgacctatatgtgcattttcttggttttgtagtaatcttaaaacacgggcctagatgggtaagcataaagacttcttcctggaaatggataaaatttgacaatttttaacctgatactttctttagcttgttaaaattaggacctcaccgtgaaagggcatattgctgtggaggctggtaggcagcaaacttgtcacctgatcttcatatgcacaaggcctgtattccactggtctataaaatctgaaatcataaaaccaaaaatatccaattgcccaactcactgagcagctaatatagttctagaaatctcacttttcttcttctcacctgtttacttcaacaccatgtgtccccaaacctaaggccctccaaaattgagctccataaaaatcaaaaccccaatcttgaaaattaagccttgagtactgaacagttacatcagcaattcctcaagggcaatttcaaaagctttcctgggagactactggaaagatggcacagggatatcaccatgcactatgtgtgcaacaactttgatatattctaagaatcacaaagaacaaaggcatgaaaatcaatgtaattttttttctttcactagaaaaatacagattcttcattttaaagcaaaaaagcaaaaagtagccacatcttgactggacaaacttacagttgaccctcagtatccatgggagattggttctgggacctctctaggaaaccaaaatccacagatgctcaagtcccttacataaaatagtgtagtatttgcatttaacctaatcacattctcccacatactttaaatcatctctaggttacttataacacctaatacaagtaaatgccatgtattaataaatcgttgttacactgtattgtttagggaattgtggcaagaaaaaaactatatatattctattccatctattcccccacacccaaaatatttttgatctgcagctggttaaatccacagatgcagaacccaggcacaggaagggctgactgtatgtgaccgggagtggagggggatctatataaatatttccacaaaatagcaaagggtacttgggattgggagcatgaacagaaatgaaaacaaaccattataaatttaaagatgactggttatcacttaaatttagtgtctacagctatttatttataaaatggtaattgtgttttaaaactttcaatggcaacaagttacaacagtaacttcagaatagcgttcacttgaaaacattgggtgaatggcctctataatttttttagctgaaatgtatacaccgccacgcagtgaggaaacttgactttagcacccttttggtatttttaatagaaaaaacagtggagaagattttcacatgtctagaaaggtaacatgttcaacttaggtttggccaatgctgattctgaggacagtactacacccgcaagcttccaaactacttcctgattcattcagattttcattggagagctgtcatcctgctactgacctcattcaacccagttcggagtgagagatcagcggattaccgcgctaggtaccgtagctgtacgccatattgtgtttttcgctaatgtttagtttgtgtgtgtgcctagcatatgtttgtgcaagtgtgtttatcaatagaacttttagaaaatccctgcctcctgcctcttcagcatccttaaaaaggataacagctgggggcggggggtggggggaggacccaaaagccacacagacaggaatacattaaacagtgtacgagagacggcatttgttttaaactttcaagaaccttccaaccatttttatatcaggaatcaaaaagtgttaacatgttttaatgtttccgaagtggcccaaagaagagaaagaaggaaaggtgtgtcttcccttcccaagccccctcctctctagtcgtagaagcgaagcaggcgggggccgggagctccggcgtctggagagacatccagcggctgtggggccaggacacctcctgccccccagttctctgaagacgctccagagaccgcgagagccacggcaagcgggggagggcgaggagggagggggcagaagacaagcgggcgcctctagcagctcctgagccccggctagtccccctcagctcctcttcttggaagcagcggctccaggcgcagggagtagagagaagaaggcagaagacacgtttccagctgcgggacgtcccgcccgccccgccacccttcgaccctcccgcgcctccctcccacctccccgccgggtcgggcgaggcagccgccgggcgctaagaagggcgccgggggagggggcgcgggcggggcggggcggggcggggcgcgggggcgcgcgcgctcatccagctcagggcccgctggctcgccgctctgtaactcgctcccccaaccccaccccgctcccctccttcccagtcccgccgccccccactccaggcgcctcgcagacgcctcatccccctcggcacgcacacactcctccctctctcccgcccgtcccacaacaaattagagtttgtggcattacctcctcgcgctctttaatcttctttcctcaactcctaaacttccccccgcccctacttcttc
